United States Patent
Park et al.

(10) Patent No.: US 10,704,064 B2
(45) Date of Patent: Jul. 7, 2020

(54) RECOMBINANT YEAST PRODUCING 3-HYDROXYPROPIONIC ACID AND METHOD FOR PRODUCING 3-HYDROXYPROPIONIC ACID USING THE SAME

(71) Applicant: SK Innovation Co., Ltd., Seoul (KR)

(72) Inventors: Joong Min Park, Seoul (KR); Jae Yeon Park, Seoul (KR); Woo Chan Park, Sejong-si (KR); Sang Min Lee, Seoul (KR); Young Bin Seo, Seoul (KR); Merja Oja, Espoo (FI); Outi Koivistoinen, Espoo (FI); Andrew Conley, Espoo (FI); Marja Ilmen, Helsinki (FI); Laura Ruohonen, Helsinki (FI); Paula Jouhten, Espoo (FI)

(73) Assignee: SK Innovation Co., Ltd., Seoul (KR)

( * ) Notice: Subject to any disclaimer, the term of this patent is extended or adjusted under 35 U.S.C. 154(b) by 0 days.

(21) Appl. No.: 15/506,981

(22) PCT Filed: Aug. 28, 2015

(86) PCT No.: PCT/KR2015/009061
§ 371 (c)(1),
(2) Date: Feb. 27, 2017

(87) PCT Pub. No.: WO2016/032279
PCT Pub. Date: Mar. 3, 2016

(65) Prior Publication Data
US 2017/0240932 A1    Aug. 24, 2017

(30) Foreign Application Priority Data

Aug. 29, 2014 (KR) .................. 10-2014-0114505

(51) Int. Cl.
| | | |
|---|---|---|
| C12N 1/16 | (2006.01) | |
| C12P 7/42 | (2006.01) | |
| C12N 9/04 | (2006.01) | |
| C12N 9/02 | (2006.01) | |
| C12N 9/00 | (2006.01) | |
| C12N 1/18 | (2006.01) | |
| C12N 15/52 | (2006.01) | |

(52) U.S. Cl.
CPC .................. *C12P 7/42* (2013.01); *C12N 1/16* (2013.01); *C12N 1/18* (2013.01); *C12N 9/0006* (2013.01); *C12N 9/0008* (2013.01); *C12N 9/93* (2013.01); *C12N 15/52* (2013.01); *C12Y 101/01059* (2013.01); *C12Y 102/0101* (2013.01); *C12Y 102/01075* (2013.01); *C12Y 604/01002* (2013.01)

(58) Field of Classification Search
None
See application file for complete search history.

(56) References Cited

U.S. PATENT DOCUMENTS

| | | |
|---|---|---|
| 7,655,451 B2 | 2/2010 | Liao et al. |
| 2010/0248233 A1 | 9/2010 | Muller et al. |
| 2012/0135481 A1* | 5/2012 | Jessen ................ C12N 1/18 435/141 |
| 2013/0071893 A1 | 3/2013 | Lynch et al. |

FOREIGN PATENT DOCUMENTS

JP         200835727 A    2/2008

OTHER PUBLICATIONS

Alber et al.; "Malonyl-Coenzyme A Reductase in the Modified 3-Hydroxypropionate Cycle for Autotrophic Carbon fixation in Archaeal Metallosphaera and Sulfolobus spp."; Journal of Bacteriology; 2006; pp. 8551-8559; vol. 188:24.
Berg et al.; "A 3-Hydroxypropionate/4-Hydroxybutyrate Autotrophic Carbon Dioxide Assimilation Pathway in Archaea"; Science; 2007; pp. 1782-1786; vol. 318.
Chen et al.; "Coupled incremental precursor and co-factor supply improves 3-hydroxypropionic acid production in *Saccharomyces cerevisiae*"; Metabolic Engineering; 2014; pp. 104-109; vol. 22.
Diacovich et al.; "Kinetic and Structural Analysis of a New Group of Acyl-CoA Carboxylases Found in Streptomyces coelicolor A3(2)*"; The Journal of Biological Chemistry; 2002; pp. 31228-31236; vol. 277:34.
Hugler et al.; "Malonyl-Coenzyme A Reductase from Chloroflexus aurantiacus, a Key Enzyme of the 3-Hydroxypropionate Cycle for Autotrophic CO2 Fixation"; Journal of Bacteriology; 2002; pp. 2404-2410; vol. 184:9.
Kockelkorn et al.; "Malonic Semialdehyde Reductase, Succinic Semialdehyde Reductase, and Succinyl-Coenzyme A Reductase from Metallosphaera sedula: Enzymes of the Autotrophic 3-Hydroxypropionate/4-Hydroxybutyrate Cycle in Sulfolobales"; Journal of Bacteriology; 2009; pp. 6352-6362; vol. 191:20.
Kozak et al.; "Replacement of the *Saccharomyces cerevisiae* acetyl-CoA synthetases by alternative pathways for cytosolic acetyl-CoA synthesis"; Metabolic Engineering; 2014; pp. 46-59; vol. 21.
Kroeger et al.; "A spectrophotometric assay for measuring acetyl-coenzyme A carboxylase"; Analytical Biochemistry; 2011; pp. 100-105; vol. 411.

(Continued)

*Primary Examiner* — Richard G Hutson
(74) *Attorney, Agent, or Firm* — The Webb Law Firm

(57) ABSTRACT

Provided are a recombinant yeast producing 3-hydroxypropionic acid (3-HP) and a method for producing 3-HP using the same, more particularly, a recombinant yeast producing 3-HP, comprising an exogenous AADH gene; an endogenous or exogenous ACC gene; an exogenous MCR gene; and an exogenous HPDH gene, and producing 3-HP through [Pyruvate Acetaldehyde→Acetyl-CoA Malonyl-CoA Malonate semialdehyde 3-HP] biosynthesis pathway, and a method for producing 3-HP using the same.

4 Claims, 3 Drawing Sheets

Specification includes a Sequence Listing.

(56) References Cited

OTHER PUBLICATIONS

Membrillo-Hernandez et al.; "Evolution of the adhE Gene Product of *Escherichia coli* from a Functional Reductase to a Dehydrogenase"; The Journal of Biological Chemistry; 2000; pp. 33869-33875; vol. 275:43.

NCBI; "3-hydroxyisobutyrate dehydrogenase [Pseudomonas aeruginosa PAO1]"; GenBank accession No. AAG06957.1; Jan. 31, 2014.

NCBI; "malonyl-CoA reductase [Chloroflexus aurantiacus]"; GenBank accession No. AAS20429.1; Feb. 22, 2004.

NCBI; malonyl-CoA/succinyl-CoA reductase [Sulfolobus tokodaii str. 7]; GenBank accession No. BAB67276.1; Oct. 7, 2016.

NCBI; "ACC1 [*Saccharomyces cerevisiae*]"; GenBank accession No. CAA96294.1; Jul. 14, 2016.

Shi et al.; "Improving Production of Malonyl Coenzyme A-Derived Metabolites by Abolishing Snf1-Dependent Regulation of Acc1"; mBio.asm.org; 2014; pp. 1-8; vol. 5:3.

Stojiljkovic et al.; "Ethanolamine Utilization in *Salmonella typhimurium*: Nucleotide Sequence, Protein Expression, and Mutational Analysis of the cchA cchB eutE eutJ eutG eutH Gene Cluster"; Journal of Bacteriology; 1995; pp. 1357-1366; vol. 177:5.

Wei et al.; "Enhanced biofuel production through coupled acetic acid and xylose consumption by engineered yeast"; Nature Communications; 2013; pp. 1-8.

Yao et al.; "The Catalytic Property of 3-Hydroxyisobutyrate Dehydrogenase from Bacillus cereus on 3-Hydroxypropionate"; Appl Biochem Biotechnol; 2010; pp. 694-703; vol. 160.

Kildegaard et al., "Engineering and systems-level analysis of *Saccharomyces cerevisiae* for production of 3-hiydroxypropionic acid via malonyl-CoA reductase-dependent pathway", Microbial Cell Factories, 2016, 13 Pages, vol. 15:53.

NCBI GenBank AGE74568.1, Jan. 31, 2014.

* cited by examiner

[Fig. 1]
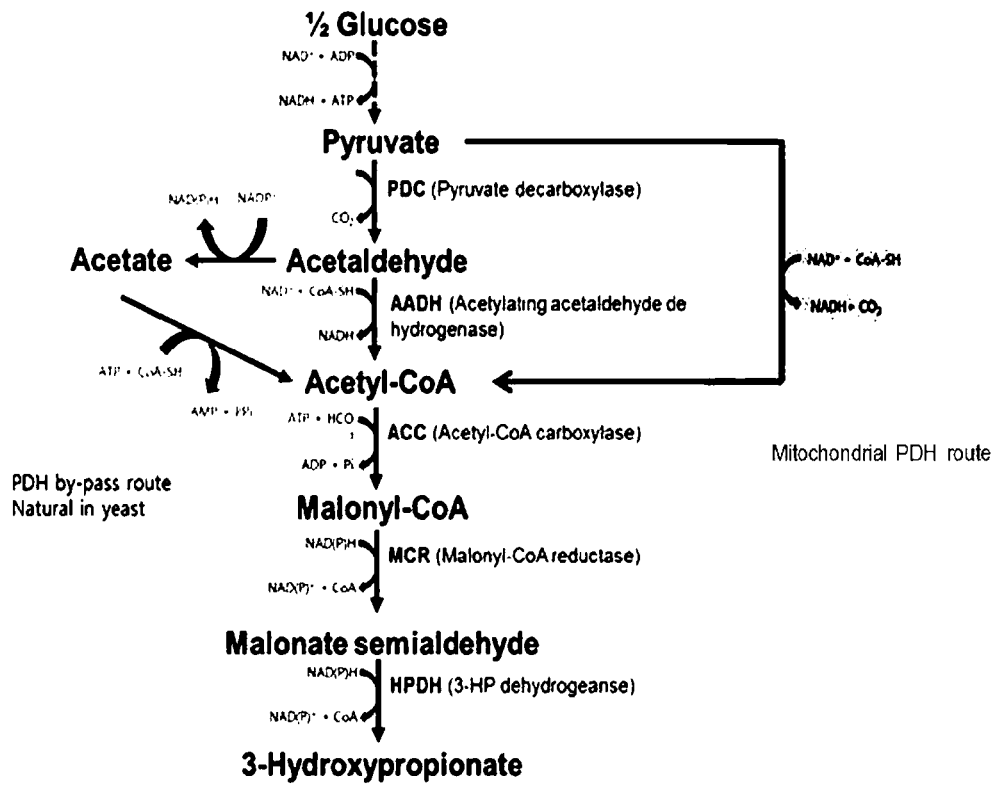
[Fig. 2]
ACC1ch < ACCmc < ACCsc$^{S659A}$ < ACCsc < ACCsc$^{S1157A}$ ~ ACCsc$^{S659A/S1157A}$ ~ ACCke < ACCyl
[Fig. 3]
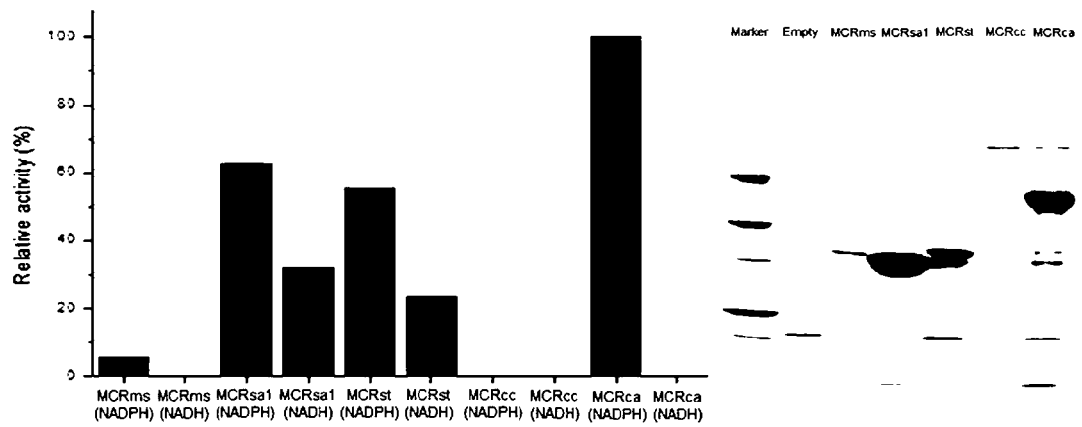

[Fig. 4]
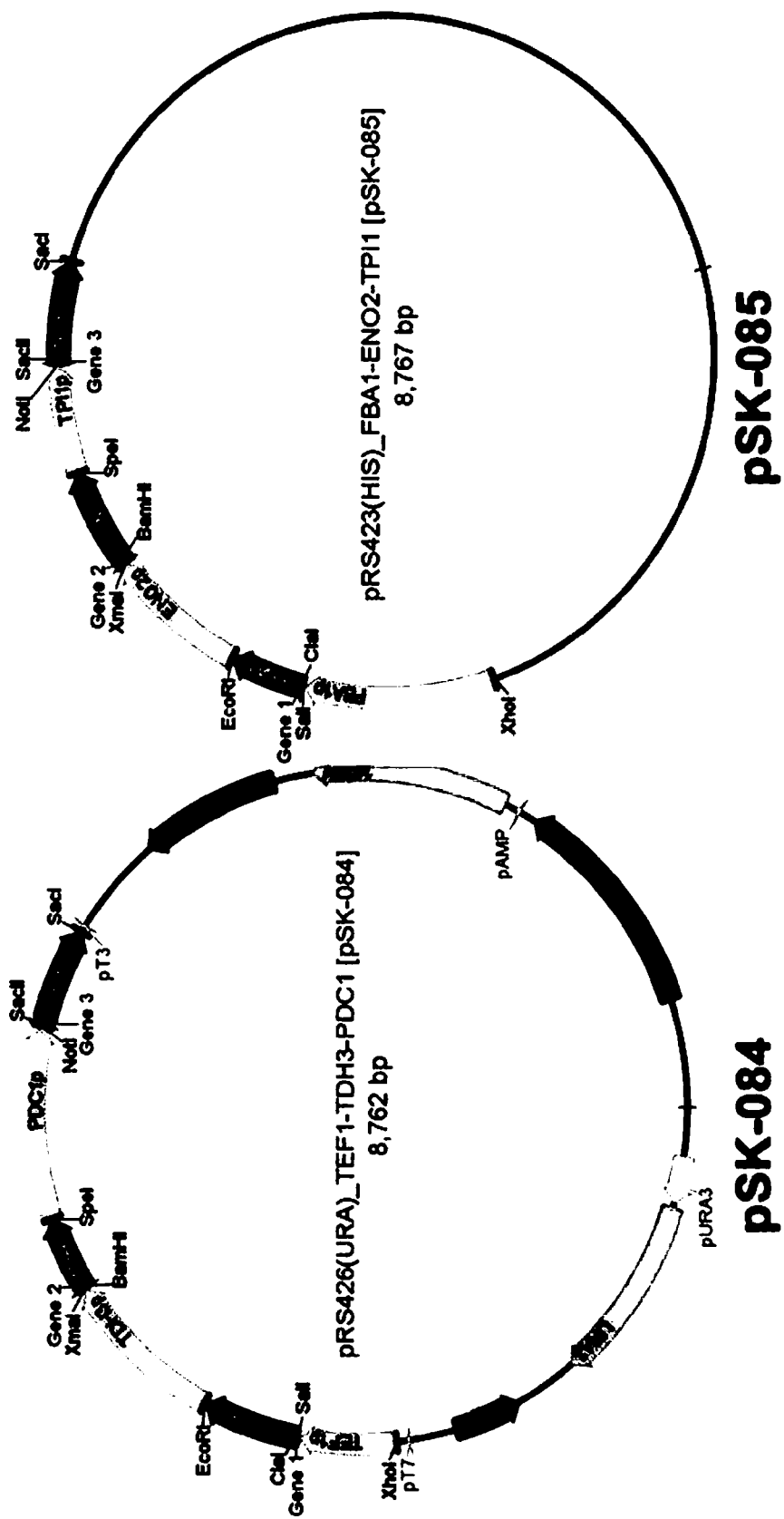

[Fig. 5]
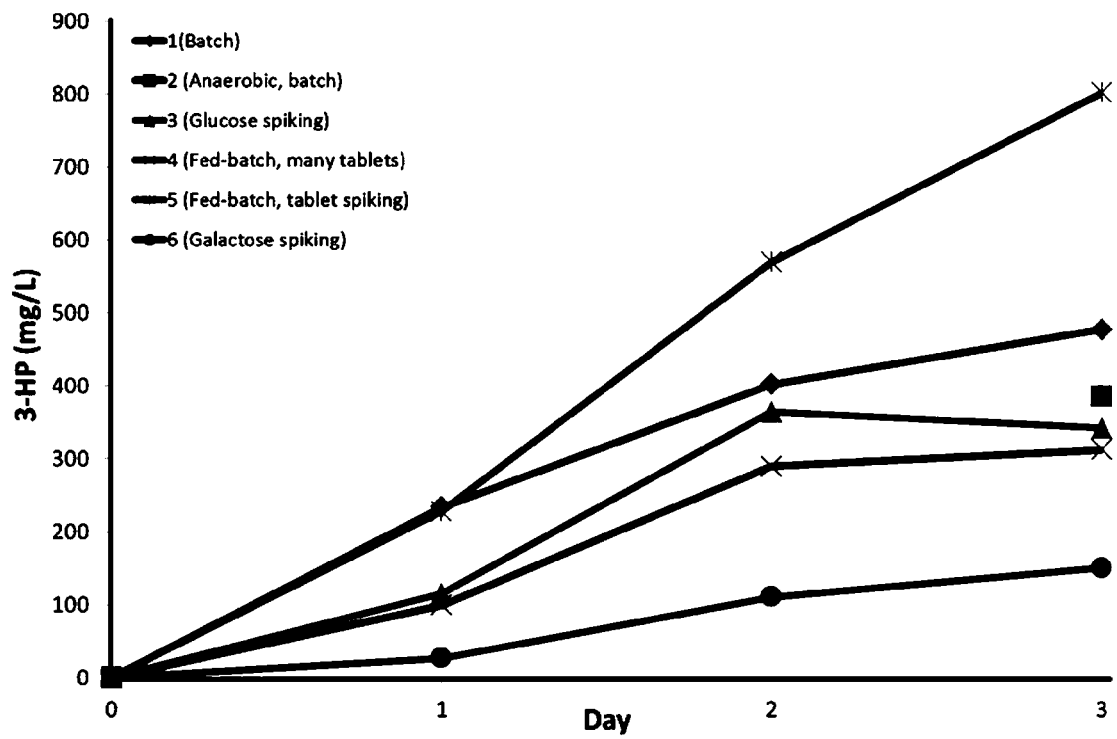
[Fig. 6]
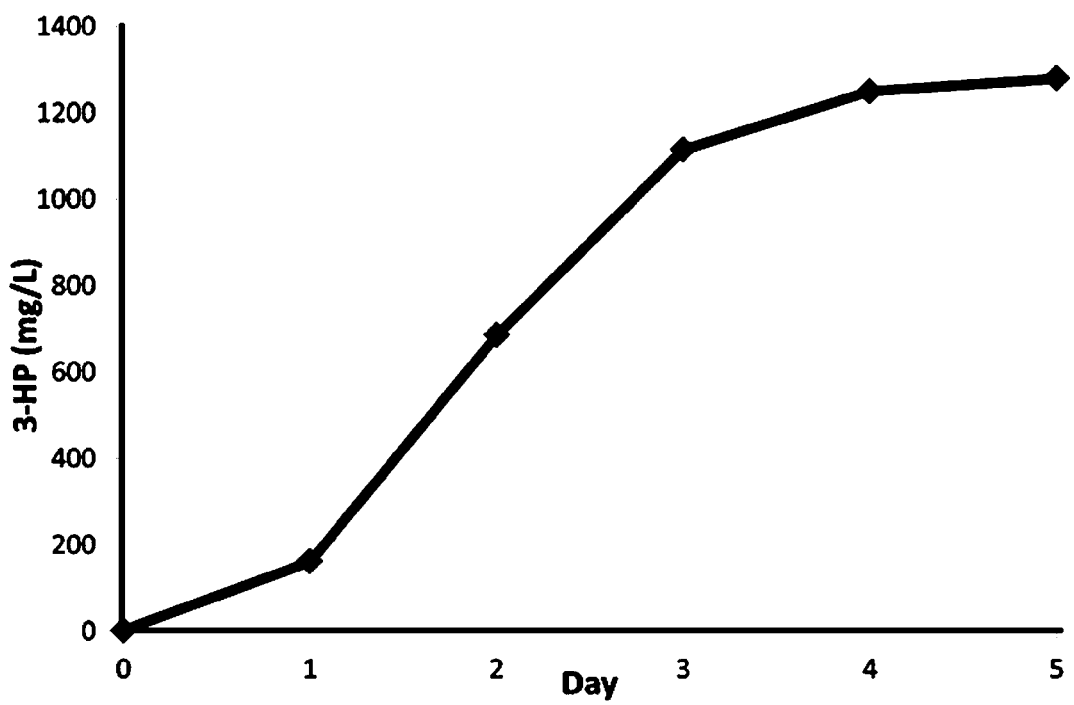

RECOMBINANT YEAST PRODUCING 3-HYDROXYPROPIONIC ACID AND METHOD FOR PRODUCING 3-HYDROXYPROPIONIC ACID USING THE SAME

CROSS-REFERENCE TO RELATED APPLICATIONS

This application is the United States national phase of International Application No. PCT/KR2015/009061 filed Aug. 28, 2015, and claims priority to Korean Patent Application No. 10-2014-0114505 filed Aug. 29, 2014, the disclosures of which are hereby incorporated in their entirety by reference.

The Sequence Listing associated with this application is filed in electronic format via EFS-Web and is hereby incorporated by reference into the specification in its entirety. The name of the text file containing the Sequence Listing is 1701700-2_ST25.txt. The size of the text file is 1,479,363 bytes, and the text file was created on Oct. 22, 2018.

TECHNICAL FIELD

The present invention relates to a recombinant yeast producing 3-hydroxypropionic acid (3-HP) and a method for producing 3-HP using the same, and more particularly, to a recombinant yeast producing 3-HP, comprising an exogenous gene encoding AADH; an endo- or exo-genous gene encoding ACC; an exogenous gene encoding MCR; and an exogenous gene encoding HPDH, and producing 3-HP through the [Pyruvate→Acetaldehyde→Acetyl-CoA→Malonyl-CoA→Malonate semialdehyde→3-HP] biosynthesis pathway, and a method for producing 3-HP using the same.

BACKGROUND ART

3-HP (3-hydroxypropionic acid, C3) is an isomer of lactic acid (2-hydroxypropionic acid) and it has a carboxylic acid group and a hydroxyl group at both ends thereof, and thereby it is a useful material capable of being converted into various chemicals such as 1,3-propanediol, acrylic acid, acrylamide, a polymer, and the like. Actually, due to the above mentioned reason, 3-HP was selected as one of the promising chemicals that can be produced from biomass by the U.S. Department of Energy in 2004. Particularly, acrylic acid could be a major applied form of 3-HP, as highly marketable material used in a coating material, an adhesive, an additive, a diaper, or the like. 3-HP may be theoretically produced from various biomass such as glucose through fermentation at a yield of 100%, and a fermentation process using microorganisms is suitable for satisfying the demand for an eco-friendly and renewable material.

There is yet no case of commercial production of 3-HP using biomass, but research into various methods has been conducted, and the securing of an economical 3-HP producing strain is emerging as a major obstacle. Bacteria are known as representative microorganisms producing organic acids and widely used in industry such as a food industry, or the like. However, there are disadvantages for applying production of organic acid using industrial bacteria such as E. coli to large-scale chemical industry such as 3-HP production. As the production amount of organic acid is increased, a hydrogenated form of acid is increased and acidity is increased (pH is decreased), and thereby activity of most of the E. coli is decreased. In the case of producing an organic acid at a high concentration, bacteria require a base such as sodium hydroxide (NaOH) and ammonium hydroxide ($NH_4OH$) for maintaining a neutral pH. This causes an increase in the cost of the fermentation process depending on an injected base, makes an extraction and separation process difficult, or significantly increases the cost.

In a recent case of application of producing organic acid to chemical industry, an organic acid is produced from glucose using yeast. Yeast has high resistance against an organic acid as compared to bacteria, thus the activity of the yeast is not significantly inhibited even at a high acidity (low pH) making yeast as more suitable host for producing the organic acid. Particularly, yeast has been conventionally widely used as an industrial biocatalyst for producing spirits, industrial ethanol, or the like, and may be mass-cultured and may not be contaminated with bacteriophages, such that applicability of the yeast in the chemical industry is more excellent as compared to bacteria. Yeast has advantages for producing an organic acid, but there are several disadvantages for using the yeast to produce an organic acid such as 3-HP. First, it is more difficult to genetically modify yeast as compared to bacteria, and in order to express a specific metabolic enzyme, the sub-cellular location for expression of the metabolic pathway along with the specific metabolic enzyme should be identified due to the shape of the cells divided into intracellular structural bodies such as mitochondria, peroxisomes, or the like, unlike bacteria. For example, a representative metabolic intermediate such as acetyl-CoA is mainly produced in the mitochondria in yeasts. However, if a target product is produced in the cytosol, a method for producing acetyl-CoA in the cytosol is also required. In addition, since there is large number of different yeast in the fungal kingdom and all of the yeast do not satisfy requirements for high productivity, resistance against an organic acid and massive cultivation, a host suitable for producing the organic acid should be effectively selected.

It is known that some yeast effectively produce ethanol from glucose, which is a hexose, and some yeast species also produce an organic acid. At the time of modification for producing a target product using microorganisms, it is important to maintain an entire balance of oxidation and reduction for a metabolic reaction, and also, a metabolic reaction of fermenting ethanol from glucose is a suitably maintained reaction. Even in the case of genetically modifying yeast to produce an organic acid, the balance as described above should be appropriately maintained, and in a case of producing lactic acid through modification of yeast, balanced introduction of lactic acid dehydrogenase (LDH) of another reduction reaction for complementing a reduction reaction of producing ethanol from acetaldehyde is important.

It is known that a small amount of 3-HP is produced in a small number of microorganisms such as *Chloroflexus aurantiacus*, and 3-HP is partially formed from a decomposition process of dimethylsulfoniopropionate in microorganisms such as *Alcaligenes faecalis* or a decomposition process of uracil in yeast. Research for 3-HP metabolic pathways and the corresponding enzymes have been conducted through discovery of 3-HP present in nature as described above, and based on the research, recently, research for a technology of producing 3-HP or a PHA, which is a polymer form of 3-HP, by introducing a gene required for 3-HP biosynthesis in *E. coli* has been conducted. In addition, in order to maximize productivity and production yield of 3-HP which is only present as a metabolic intermediate or produced only at a small amount in nature, technologies such as a metabolic engineering technology, a systems biology technology, a synthetic biology technology, or the like, have to be utilized.

According to the development of the metabolic engineering technology, it becomes possible to predict production pathways of various materials using microorganisms, and a pathway for producing 3-HP from glucose may be roughly divided into an acryloyl-CoA pathway, a β-alanine pathway, a malonyl-CoA pathway, and a glycerol pathway depending on metabolic intermediates.

The acryloyl-CoA pathway means a metabolic pathway of converting pyruvate or phosphoenol pyruvate (PEP) obtained from the glycolysis of glucose into acryloyl-CoA via lactate or β-alanine and then converting the acryloyl-CoA into 3-HP through a hydration reaction and a reduction reaction (pyruvate or PEP→lactate or β-alanine→acryloyl-CoA→3-HP). Acryloyl-CoA is a metabolite observed during the decomposition process of propionic acid, and since the Gibb's free energy value for formation of the metabolite is positive, a forward reaction is an unfavourable reaction. In addition, substrate specificity of acryloyl-CoA thioesterases is low, such that the acryloyl-CoA pathway is not suitable as the metabolic pathway for mass-producing 3-HP.

The β-alanine pathway means a metabolic pathway of converting pyruvate or oxaloacetate into amino acid by a transamination reaction and finally conversion into 3-HP via β-alanine by a transamination reaction (pyruvate or oxaloacetate→amino acid→β-alanine→3-HP; US 2012/0135481A1). Since the transamination reaction of β-alanine to 3-HP proceeds via malonate semialdehyde which is highly toxic to microorganisms, a 3-HP dehydrogenase having a high activity is required. In addition, generally, since the transamination reaction forms a radical form of an amino acid molecular structure in a steady-state, an enzyme of this reaction has a structure for alleviating reactivity of the radical. Since this radical has strong reactivity with oxygen, for a smooth transamination reaction, anaerobic conditions or a coenzyme for stabilizing radical molecules are essentially required.

The malonyl-CoA pathway is a metabolic pathway of converting acetyl-CoA into malonyl-CoA by carboxylation and then converting malonyl-CoA into 3-HP by a reduction reaction (acetyl-CoA→malonyl-CoA→3-HP), and the glycerol pathway is a metabolic pathway of converting glucose into glycerol, converting glycerol into 3-hydroxypropionaldehyde by a dehydration reaction, and then converting 3-hydroxypropionaldehyde into 3-HP (glucose→glycerol→3-hydroxypropionaldehyde→3-HP). Since the malonyl-CoA pathway and the glycerol pathway proceed through an intermediate generally produced by microorganisms such as E. coli, or the like, these pathways have been mainly studied as the 3-HP production pathway (US 2013/0071893 A1). Since malonyl-CoA may be converted into 3-HP by malonate reductase and 3-HP dehydrogenase, and glycerol may be converted into 3-HP by glycerol dehydratase and aldehyde dehydrogenase, a method for converting glucose or glycerol into 3-HP using modified E. coli has been well known. A dehydration reaction of glycerol, which is a reaction accompanied with radicals similarly to the transamination reaction, essentially requires coenzyme B12 for performing the reaction in the presence of oxygen.

In view of industrial fermentation, since it is difficult to use a coenzyme such as coenzyme B12 as a material of a culture medium due to its cost, and microorganisms such as yeast may not biosynthesize or absorb the corresponding material in cells, the β-alanine pathway or glycerol pathway is not suitable as the metabolic pathway for producing 3-HP using yeast. Recently, research modifying the key enzymes for overcoming this problem has been reported. [U.S. Pat. No. 7,655,451 B2]

Malonyl-CoA is synthesized from acetyl-CoA in the cytosol, and can thereby be reduced to 3-HP. In the case of bacteria such as E. coli, acetyl-CoA is formed from pyruvate in the cytosol, and can thereby be used as a substrate of the TCA cycle or other metabolic reaction. However, as described above, in yeast having independent sub-cellular compartments, generally, acetyl-CoA is synthesized in the mitochondria and is used as a substrate of the TCA cycle, and acetyl-CoA in the cytosol is produced via acetate producing reaction, which is a side-reaction of an ethanol production reaction, or a citric acid circulation reaction. All of the reactions of producing acetyl-CoA from acetate or citric acid are reactions consuming ATP, and since yeast further consumes energy in order to obtain acetyl-CoA in cytosol as compared to bacteria, yeast may be disadvantageous in view of energetics.

In yeast, environments such as the reduction state of the cytosol, folding after protein synthesis, codon usage, and the like, are different from those in bacteria, such that at the time of expressing an exogenous enzyme derived from bacteria, an activity thereof may not be exhibited or the activity may be significantly decreased. In addition, since the activity may be significantly changed by the presence or absence of oxygen or other metal ions, even in the case of exogenous enzymes having the same functions, expression results thereof in yeast may be different according to the origins of the enzymes. Actually, in the case of xylose isomerase (XI), which is an important enzyme of xylose metabolism, at the time of expressing XI derived from bacteria in yeast, mostly, an activity thereof was significantly low, but it was shown that yeast was successfully modified so as to perform xylose metabolism at a relatively high activity by introducing XI derived from anaerobic fungus. Thus, in the case of introducing a metabolic pathway derived from bacteria or Archaea such as the malonyl-CoA pathway in yeast, a gene having a high activity should be secured through genes performing the same functions with various origins.

There are various papers and patents associated with a method of genetically modifying Saccharomyces cerevisiae among various yeast strains to produce 3-HP, but in the case of Saccharomyces cerevisiae, since 3-HP is produced by the [pyruvic acid→acetaldehyde→acetic acid→acetyl-CoA-→malonyl-CoA→malonate semialdehyde→3-HP] pathway, there are problems that this metabolic pathway to produce 3-HP is complicated, and productivity of 3-HP is relatively low (US 2010/0248233A1; Y. Chen et al., *Metabolic Engineering*, 22:104-109, 2014).

Accordingly, as a result of an effort to solve the above-mentioned problems, in order to overcome the disadvantage of yeast where ATP is consumed in a process of obtaining acetyl-CoA in cytosol, the present inventors conceived a shorter metabolic pathway of [Pyruvate→Acetaldehyde→Acetyl-CoA→Malonyl-CoA→Malonate semialdehyde→3-HP], which is directly converting acetaldehyde into acetyl-CoA without passing through an acetate intermediate, and confirmed that in the case of using a recombinant yeast comprising this pathway, unlike the case of using E. coli, not only the use of pH adjusting materials is decreased, and thereby production of salts is decreased, but also 3-HP may be produced from biomass at a high concentration and a high yield even at a low pH, thereby completing the present invention.

SUMMARY OF THE INVENTION

An object of the present invention is to provide a recombinant yeast comprising an active 3-HP biosynthetic pathway of [Pyruvate→Acetaldehyde→Acetyl-CoA→Malonyl-CoA→Malonate semialdehyde→3-HP], converting acetaldehyde directly to acetyl-CoA and not via acetate.

Another object of the present invention is to provide a method for producing 3-HP using the recombinant yeast.

Solution to Problem

In order to achieve the foregoing objects, the present invention provides a recombinant yeast comprising an active 3-HP biosynthetic pathway of [Pyruvate→Acetaldehyde→Acetyl-CoA→Malonyl-CoA→Malonate semialdehyde→3-HP], wherein the yeast comprises: an exogenous gene encoding AADH; an endo- or exo-genous gene encoding ACC; an exogenous gene encoding MCR; and an exogenous gene encoding HPDH.

In the present invention, said yeast is acid-resistant and selected from the group consisting of for example the genera Saccharomyces, Kazachstania and Candida. Yeast species of particular interest include Saccharomyces cerevisiae, Kazachstania exigua, Kazachstania bulderi, and Candida humilis where species are not limited only by those.

In addition, the present invention provides a method of preparing 3-HP comprising: (a) culturing the recombinant yeast of any one of claims 1-10 in a medium including at least one carbon source, thereby producing 3-HP; and (b) isolating 3-HP from the culture.

BRIEF DESCRIPTION OF THE DRAWINGS

FIG. 1 shows a pathway of producing 3-HP from glucose of the recombinant yeast of the present invention (modified malonyl-CoA metabolic pathway) and major enzymes.

FIG. 2 shows relative ranking on ACC1 activity of Acetyl-CoA carboxylase enzymes.

FIG. 3 shows results of confirming relative activity (left) and expression levels (SDS-PAGE) (right) of the archaeal MCR variants.

FIG. 4 shows yeast expression plasmids pSK-084 and pSK-085 for expressing enzymes related with 3-HP pathway.

FIG. 5 shows results of testing cultivation conditions that could effect on the 3-HP production levels.

FIG. 6 shows 3-HP production with a more established 3-HP production strain using fed-batch (tablet spiking) cultivation conditions.

DESCRIPTION OF THE INVENTION

Unless defined otherwise, all the technical and scientific terms used herein have the same meanings as those generally understood by persons skilled in the art to which the present invention pertains. Generally, the nomenclature used herein are well known and commonly employed in the art.

Generally, in yeast, since acetyl-CoA is prepared by the pathway of [acetaldehyde→acetate→acetyl-CoA], and acetate is produced in cytosol of yeast, ATP is consumed by converting into AMP in the process of producing acetyl-CoA (FIG. 1; Y. Chen et al., Metabolic Engineering, 22:104-109, 2014).

However, in the present invention, a pathway where disadvantages of yeast consuming ATP is overcome and improved by directly preparing acetyl-CoA from acetaldehyde, not via acetate, in the process of producing acetyl-CoA in cytosol (FIG. 1) is designed and applied. As a result, in case of using the recombinant yeast of the present invention, it is demonstrated that 3-HP is produced in a high concentration and a high yield from glucose even at a low pH.

Therefore, in one aspect, the present invention is directed to a recombinant yeast comprising an active 3-HP biosynthetic pathway of [Pyruvate→Acetaldehyde→Acetyl-CoA→Malonyl-CoA→Malonate semialdehyde→3-HP], wherein the yeast comprises: an exogenous gene encoding AADH; an endo- or exo-genous gene encoding ACC; an exogenous gene encoding MCR; and an exogenous gene encoding HPDH.

The 3-HP biosynthetic pathway of [Pyruvate→Acetaldehyde→Acetyl-CoA→Malonyl-CoA→Malonate semialdehyde→3-HP] is a pathway of producing 3-HP from a carbon source such as glucose, etc. (i) "Pyruvate→Acetaldehyde" means a pathway of producing acetaldehyde from pyruvate using pyruvate decarboxylase (PDC) without producing an intermediate; (ii) "Acetaldehyde→Acetyl-CoA" means a pathway of producing acetyl-CoA from acetaldehyde using acetylating acetaldehyde dehydrogenase (AADH) without producing an intermediate such as acetate; (iii) "Acetyl-CoA→Malonyl-CoA" means a pathway of producing malonyl-CoA from acetyl-CoA using acetyl-CoA carboxylase (ACC) without producing an intermediate; (iv) "Malonyl-CoA→→3-HP or Malonyl-CoA→Malonate semialdehyde→3-HP" means a pathway of producing 3-HP from malonyl-CoA using bi-functional Malonyl-CoA reductase (MCR) without producing an intermediate or a pathway of producing 3-HP from malonate semialdehyde by biosynthesizing malonate semialdehyde using a mono-functional malonyl-CoA reductase (FIG. 1).

In the present invention, the PDC gene is not engineered, but engineering the PDC gene to increase the 3-HP production rate, for example, by amplifying the PDC gene present in yeast, by applying well-known prior art in the technical field, can be done.

In an exemplary embodiment of the present invention, genes encoding pathway enzymes which have specific function were extracted through bioinformatics genome mining of pathway enzyme candidates.

The present invention comprises an exogenous gene encoding AADH. In an embodiment, the gene encoding AADH is a nucleic acid encoding AADH having an amino acid sequence of at least 60%, preferably at least 70%, 80%, 90%, 91%, 92%, 93%, 94%, 95%, 96%, 97%, 99% or 100% sequence identity to a AADH amino acid sequence selected from the group consisting of amino acid sequences represented in Tables 1-3 below, but not limited thereto as long as having function of biosynthesizing acetyl-CoA from acetaldehyde.

TABLE 1

AADH (adhE type)

| Gene | GenBank Accession No. (Amino Acid Sequences) | GI No. | Organism | Abbreviation |
|---|---|---|---|---|
| adhE (SEQ ID NO: 145) | NP_415757.1 | 16129202 | *Escherichia coli* K-12 substr. MG1655 | ADHEec |
| adhE (SEQ ID NO: 146) | AY282576.1 | 33578054 | *Piromyces* sp. E2 | ADHEpm |
| adhE (SEQ ID NO: 147) | NP_370672.1 | 15923138 | *Staphylococcus aureus* subsp. *aureus* Mu50 | ADHEsa |
| P343_14875 (SEQ ID NO: 148) | EST10864.1 | 558501608 | *Sporolactobacillus laevolacticus* DSM 442 | ADHEsl |
| UCRPA7_2908 (SEQ ID NO: 149) | EOO01596.1 | 500258690 | *Togninia minima* UCRPA7 | ADHEtm |
| (SEQ ID NO: 150) | WP_020582522 | 522071313 | *Endozoicomonas elysicola* | ADHEee |
| RW1_006_00090 (SEQ ID NO: 151) | GAF43117.1 | 589262551 | *Rhodococcus wratislaviensis* NBRC 100605 | ADHErw |

TABLE 2

AADH (eutE type)

| Gene | GenBank Accession No. (Amino Acid Sequences) | GI No. | Organism | Abbreviation |
|---|---|---|---|---|
| eutE (SEQ ID NO: 152) | YP_001459232.1 | 157161914 | *Escherichia coli* HS | EUTEec |
| (SEQ ID NO: 153) | YP_003003316.1 | 251788595 | *Dickeya zeae* Ech1591 | EUTEdz |
| (SEQ ID NO: 154) | NP_470466.1 | 16800198 | *Listeria innocua* Clip11262 | LIN1129li |
| C790_00285 (SEQ ID NO: 155) | EMP53767.1 | 468911480 | *Morganella morganii* SC01 | AADHmm |
| C666_02610 (SEQ ID NO: 156) | ENO90114.1 | 479302014 | *Thauera linaloolentis* DSM 12138 | AADHtl |
| (SEQ ID NO: 157) | WP_018205006.1 | 516997301 | *Atribacteria bacterium* SCGC AAA252-M02 | AADHab |
| Maqu_1235 (SEQ ID NO: 158) | ABM18325.1 | 120324010 | *Marinobacter aquaeolei* VT8 | AADHma1 |
| CLS_23700 (SEQ ID NO: 159) | CBK77783.1 | 295091676 | *Clostridium* cf. *saccharolyticum* K10 | AADHcs |
| Plabr_4078 (SEQ ID NO: 160) | ADY61655.1 | 324970877 | *Planctomyces brasiliensis* DSM 5305 | AADHpb |
| GCWU000342_00651 (SEQ ID NO: 161) | EEP29295.1 | 229793181 | *Shuttleworthia satelles* DSM 14600 | AADHss |
| Tola_1697 (SEQ ID NO: 162) | ACQ93307.1 | 237500714 | *Tolumonas auensis* DSM 9187 | AADHta |
| HMPREF9024_01049 (SEQ ID NO: 163) | EFA26759.1 | 270280925 | *Pediococcus acidilactici* 7_4 | AADHpa |
| BN552_01640 (SEQ ID NO: 164) | CDB76812.1 | 524431109 | *Blautia* sp. CAG: 237 | AADHbs |
| HMPREF0179_00640 (SEQ ID NO: 165) | EFV45545.1 | 316924378 | *Bilophila wadsworthia* 3_1_6 | AADHbw |
| Mahau_0819 (SEQ ID NO: 166) | AEE96017.1 | 332699076 | *Mahella australiensis* 50-1 BON | AADHma2 |
| ALO_06783 (SEQ ID NO: 167) | EGO64744.1 | 337276312 | *Acetonema longum* DSM 6540 | AADHal |
| HMPREF9200_0641 (SEQ ID NO: 168) | EGS34769.1 | 341591638 | *Veillonella* sp. oral taxon 780 str. F0422 | AADHvso |
| VEJY3_08440 (SEQ ID NO: 169) | AEX22176.1 | 369841032 | *Vibrio* sp. EJY3 | AADHvs |
| OpiT1DRAFT_04559 (SEQ ID NO: 170) | EIQ00023.1 | 391221602 | *Opitutaceae bacterium* TAV1 | AADHob |
| HSACCH_00271 (SEQ ID NO: 171) | CCU77919.1 | 460789193 | *Halanaerobium saccharolyticum* DSM 6643 | AADHhs |
| Hoch_5813 (SEQ ID NO: 172) | ACY18289.1 | 262082320 | *Haliangium ochraceum* DSM 14365 | AADHho |

TABLE 3

AADH

| Gene | GenBank Accession No. (Amino Acid Sequences) | GI No. | Organism | Abbreviation |
|---|---|---|---|---|
| sucD (SEQ ID NO: 173) | EEN82978.1 | 229317069 | *Porphyromonas endodontalis* ATCC 35406 | AADHpe |
| AZOBR_p480045 (SEQ ID NO: 174) | CCD03730.1 | 356882712 | *Azospirillum brasilense* Sp245 | AADHabr |
| HMPREF1987_01259 (SEQ ID NO: 175) | ERJ82808.1 | 543978929 | *Peptostreptococcaceae bacterium* 113 str. W5053 | AADHpba |
| Terro_0974 (SEQ ID NO: 176) | AFL87295.1 | 390411791 | *Terriglobus roseus* DSM 18391 | AADHtr |

The present invention comprises an gene encoding ACC. In an embodiment, the gene encoding ACC is a nucleic acid encoding ACC having an amino acid sequence of at least 60%, preferably at least 70%, 80%, 90%, 91%, 92%, 93%, 94%, 95%, 96%, 97%, 99% or 100% sequence identity to a ACC amino acid sequence selected from the group consisting of amino acid sequences represented in Table 4 below, but not limited thereto as long as having function of biosynthesizing malonyl-CoA from acetyl-CoA.

TABLE 4

ACC (eukaryotic multidomain type)

| Gene | GenBank Accession No. (Amino Acid Sequences) | GI No. | Organism | Abbreviation |
|---|---|---|---|---|
| ACC1 (SEQ ID NO: 177) | CAA962941 | 1302498 | *Saccharomyces cerevisiae* S288c | ACC1sc |
| YALI0C11407g (SEQ ID NO: 178) | XP_501721.1 | 50548503 | *Yarrowia lipolytica* CLIB122 | ACC1yl |
| HMPREF1544_10598 (SEQ ID NO: 179) | EPB82652.1 | 511001160 | *Mucor circinelloides* f. *circinelloides* 1006PhL | ACC1mc |
| ACC1ke (SEQ ID NO: 102) | | | *Kazachstania exigua* | ACC1ke |
| ACC1ch (SEQ ID NO: 106) | | | *Candida humilis* | ACC1ch |
| CGB_F3610C (SEQ ID NO: 180) | XP_003194770.1 | 321260100 | *Cryptococcus gattii* WM276 | ACC1cg |
| AGABI1DRAFT_70405 (SEQ ID NO: 181) | EKM81867.1 | 409081508 | *Agaricus bisporus* var. *burnettii* JB137-S8 | ACC1ab |
| BATDEDRAFT_18673 (SEQ ID NO: 182) | EGF84402.1 | 328774365 | *Batrachochytrium dendrobatidis* JAM81 | ACC1bd |
| RHTO_02004 (SEQ ID NO: 183) | EMS21133.1 | 472583500 | *Rhodosporidium toruloides* NP11 | ACC1rt |
| PITG_18706 (SEQ ID NO: 184) | EEY68805.1 | 262110753 | *Phytophthora infestans* T30-4 | ACC1pi |
| TCM_034957 (SEQ ID NO: 185) | XP_007018852.1 | 590598290 | *Theobroma cacao* | ACC1tc |
| Ot01g03240 (SEQ ID NO: 186) | CAL50235.1 | 116000555 | *Ostreococcus tauri* | ACC1ot |
| NGATSA_3002800 (SEQ ID NO: 187) | AFJ69228.1 | 387219039 | *Nannochloropsis gaditana* CCMP526 | ACC1ng |
| accA (SEQ ID NO: 188) | EAL63219.1 | 60465120 | *Dictyostelium discoideum* AX4 | ACC1dd |
| LOC101893358 (SEQ ID NO: 189) | XP_005182000.1 | 557764587 | *Musca domestica* | ACC1md |
| ACACA (SEQ ID NO: 190) | ABX09993.1 | 159895418 | *Sus scrofa* | ACC1ss |
| (SEQ ID NO: 191) | Uniprot: H2YM65 | | *Ciona savignyi* | ACC1cs |

The present invention comprises a gene encoding MCR. In an embodiment, an MCR could be bi-functional in that it has a function of converting malonyl-CoA to malonate semialdehyde and a function of converting malonate semialdehyde to 3-HP; or mono-functional in that it has a function of converting malonyl-CoA to malonate semialdehyde.

In the present invention, gene encoding said bi-functional is a nucleic acid encoding MCR having an amino acid sequence of at least 60%, preferably at least 70%, 80%, 90%, 91%, 92%, 93%, 94%, 95%, 96%, 97%, 99% or 100% sequence identity to a MCR amino acid sequence selected from the group consisting of amino acid sequences represented in Table 5 below, but not limited thereto as long as simultaneously having the function of converting malonyl-CoA to malonate semialdehyde and the function of converting malonate semialdehyde to 3-HP.

TABLE 5

MCR (bifunctional type)

| Gene | GenBank Accession No. (Amino Acid Sequences) | GI No. | Organism | Abbreviation |
|---|---|---|---|---|
| mcr (SEQ ID NO: 192) | AAS20429.1 | 42561982 | *Chloroflexus aurantiacus* | MCRca |
| Cagg_1256 (SEQ ID NO: 193) | ACL24164.1 | 219542426 | *Chloroflexus aggregans* DSM 9485 | MCRcag |
| OSCT_0547 (SEQ ID NO: 194) | EFO81531.1 | 308227877 | *Oscillochloris trichoides* DG-6 | MCRot |
| Rcas_2929 (SEQ ID NO: 195) | ABU58991.1 | 156234208 | *Roseiflexus castenholzii* DSM 13941 | MCRrc |
| OMB55_00007690 (SEQ ID NO: 196) | EHQ57048.1 | 374302864 | gamma proteobacterium HIMB55 | MCRgp |
| Cabther_B0159 (SEQ ID NO: 197) | AEP13163.1 | 347588634 | *Chloracidobacterium thermophilum* B | MCRct |
| (SEQ ID NO: 198) | WP_022680613.1 | 550932202 | *Sandarakinorhabdus limnophila* | MCRsl |
| (SEQ ID NO: 199) | WP_023839102.1 | 564013708 | *Blastomonas* sp. CACIA14H2 | MCRbs |

In another embodiment, said MCR gene could be mono-functional having function of converting malonyl-CoA to malonate semialdehyde, a gene encoding an enzyme which can convert malonate semialdehyde to 3-HP could be further comprised.

In the present invention, said gene encoding mono-functional MCR is a nucleic acid encoding MCR having an amino acid sequence of at least 60%, preferably at least 70%, 80%, 90%, 91%, 92%, 93%, 94%, 95%, 96%, 97%, 99% or 100% sequence identity to a MCR amino acid sequences selected from the group consisting of amino acid sequences represented in Table 6 below, but not limited thereto as long as having function of converting malonyl-CoA to malonate semialdehyde.

sequence of at least 60%, preferably at least 70%, 80%, 90%, 91%, 92%, 93%, 94%, 95%, 96%, 97%, 99% or 100% sequence identity to a HPDH, HIBADH, HBDH or BDH amino acid sequence selected from the group consisting of amino acid sequences represented in Tables 7-10 below, but not limited thereto as long as the protein encoding gene has the function of biosynthesizing 3-HP from malonate semialdehyde.

HPDH amino acid sequences represented in Table 7 below, HIBADH amino acid sequences represented in Table 8 below, HBDH amino acid sequences represented in Table 9 below, and BDH-amino acid sequences represented in

TABLE 6

MCR

| Gene | GenBank Accession No. (Amino Acid Sequences) | GI No. | Organism | Abbreviation |
|---|---|---|---|---|
| Msed_0709 (SEQ ID NO: 200) | ABP94884.1 | 145701742 | *Metallosphaera sedula* DSM 5348 | MCRms |
| mcr/scr (SEQ ID NO: 201) | BAB67276.1 | 15623288 | *Sulfolobus tokodaii* DSM 16993 | MCRst |
| (SEQ ID NO: 202) | WP_020198954.1 | 519043079 | *Sulfolobales archaeon* Acd1 | MCRsa1 |
| SacRon12I_11780 (SEQ ID NO: 203) | AGE74568.1 | 449039143 | *Sulfolobus acidocaldarius* Ron12/I | MCRsa2 |
| SacRon12I 10705 (SEQ ID NO: 204) | AGE74357.1 | 449038932 | *Sulfolobus acidocaldarius* Ron12/I | MCRsa3 |
| (SEQ ID NO: 205) | BAJ50751.1 | 343485097 | *Candidatus Caldiarchaeum subterraneum* | MCRcc |
| MetMK1_00028480 (SEQ ID NO: 206) | EHP68415.1 | 373523495 | *Metallosphaera yellowstonensis* MK1 | MCRmy |
| TREAZ_1307 (SEQ ID NO: 207) | AEF80380.1 | 333734431 | *Treponema azotonutricium* ZAS-9 | MCRta |

In the present invention, said gene encoding enzyme which can convert malonate semialdehyde to 3-HP is a nucleic acid encoding an enzyme having an amino acid Table 10 below are amino acid sequences of protein that function of biosynthesizing 3-HP from malonate semialdehyde.

TABLE 7

HPDH

| Gene | GenBank Accession No. (Amino Acid Sequences) | GI No. | Organism | Abbreviation |
|---|---|---|---|---|
| EC3431_0375 (SEQ ID NO: 208) | EFV00080.1 | 315619553 | *Escherichia coli* 3431 | HPDHec |
| YMR226C (SEQ ID NO: 209) | DAA10125.1 | 283814130 | *Saccharomyces cerevisiae* S288c | HPDHsc |
| Msed_1993 (SEQ ID NO: 210) | ABP96133.1 | 145702991 | *Metallosphaera sedula* DSM 5348 | HPDHms |
| STK_15070 (SEQ ID NO: 211) | BAK54608.1 | 342306519 | *Sulfolobus tokodaii* str. 7 | HPDHst |
| BWG_0862 (SEQ ID NO: 212) | ACR64730.1 | 238862732 | *Escherichia coli* BW2952 | HPDHecb |
| ATEG_09041 (SEQ ID NO: 213) | XP_001217663.1 | 115436862 | *Aspergillus terreus* NIH2624 | HPDHat |
| (SEQ ID NO: 214) | YP_902607.1 | 118581357 | *Pelobacter propionicus* DSM 2379 | HPDHpp |
| Snov_0928 (SEQ ID NO: 215) | YP_003692871.1 | 298290932 | *Starkeya novella* DSM 506 | HPDHsn |
| (SEQ ID NO: 216) | YP_004145243.1 | 319785768 | *Pseudoxanthomonas suwonensis* 11-1 | HPDHps |
| (SEQ ID NO: 217) | WP_002641751.1 | 488717875 | *Simonsiella muelleri* | HPDHsm |
| (SEQ ID NO: 218) | WP_006802623.1 | 493855747 | *Helicobacter winghamensis* | HPDHhw |
| (SEQ ID NO: 219) | WP_007116408.1 | 494180330 | *Enhydrobacter aerosaccus* | HPDHea |
| (SEQ ID NO: 220) | WP_018365922.1 | 517177104 | *Streptococcus didelphis* | HPDHsd |
| (SEQ ID NO: 221) | WP_019460509.1 | 518290301 | *Roseomonas* sp. B5 | HPDHrs |
| YDF1 (SEQ ID NO: 222) | EAZ63492.1 | 126213385 | *Pichia stipitis* CBS 6054 | HPDHpst |
| KAFR0B03360 (SEQ ID NO: 223) | CCF56633.1 | 372462351 | *Kazachstania africana* CBS 2517 | HPDHka |
| ydfG (SEQ ID NO: 224) | EGC72291.1 | 325160162 | *Haemophilus parainfluenzae* ATCC 33392 | HPDHhp |
| K788_004913 (SEQ ID NO: 225) | ETY79751.1 | 575860535 | *Burkholderia caribensis* MBA4 | HPDHbc |
| AMED_69 (SEQ ID NO: 226) | ADJ48621.1 | 299798246 | *Amycolatopsis mediterranei* U32 | HPDHam |
| CFU_3402 (SEQ ID NO: 227) | AEK63226.1 | 340553851 | *Collimonas fungivorans* Ter331 | HPDHcf |
| Rahaq2_2300 (SEQ ID NO: 228) | AEX52155.1 | 371588425 | *Rahnella aquatilis* ATCC 33071 | HPDHra |
| LS215_1598 (SEQ ID NO: 229) | ACP35603.1 | 227456916 | *Sulfolobus islandicus* L.S.2.15 | HPDHsi |
| (SEQ ID NO: 230) | WP_003467297.1 | 489562770 | *Xanthomonas translucens* | HPDHxt |
| (SEQ ID NO: 231) | WP_007747336.1 | 495021561 | *Cronobacter dublinensis* | HPDHcd |
| (SEQ ID NO: 232) | WP_021506918.1 | 545151592 | *Pantoea dispersa* | HPDHpd |
| (SEQ ID NO: 266) | EHT00469.1 | 376387763 | *Klebsiella oxytoca* 10-5245 | HPDHko |
| (SEQ ID NO: 234) | ESM32057.1 | 555088912 | *Enterobacter cloacae* BWH 31 | HPDHecl |

TABLE 8

HIBADH

| Gene | GenBank Accession No. (Amino Acid Sequences) | GI No. | Organism | Abbreviation |
|---|---|---|---|---|
| mmsB (SEQ ID NO: 235) | ADR61938.1 | 313500572 | *Pseudomonas putida* BIRD-1 | HIBADHpp |
| PA3569 (SEQ ID NO: 236) | AAG06957.1 | 9949723 | *Pseudomonas aeruginosa* PAO1 | HIBADHpa |
| BC_4042 (SEQ ID NO: 237) | AAP10961.1 | 29897686 | *Bacillus cereus* ATCC 14579 | HIBADHbc |
| QWA_01835 (SEQ ID NO: 238) | EJC65559.1 | 393165510 | *Alcaligenes faecalis* NCIB 8687 | HIBADHaf |
| (SEQ ID NO: 239) | JI420577.1 | 327223309 | *Lytechinus variegatus* | HIBADHlv |
| (SEQ ID NO: 240) | GAXL01007172.1 | 596424618 | *Chyphotes mellipes* | HIBADHcm |
| POPTR_0001s46990g (SEQ ID NO: 241) | XP_002300566.1 | 224061611 | *Populus trichocarpa* | HIBADHpt |
| (SEQ ID NO: 242) | WP_007234036.1 | 494440757 | marine gamma proteobacterium HTCC2080 | HIBADHmgp |
| (SEQ ID NO: 243) | WP_009244364.1 | 496538096 | *Clostridiales* sp. | HIBADHcs |
| (SEQ ID NO: 244) | WP_017931623.1 | 516543998 | *Robiginitomaculum antarcticum* | HIBADHra |

TABLE 8-continued

HIBADH

| Gene | GenBank Accession No. (Amino Acid Sequences) | GI No. | Organism | Abbreviation |
|---|---|---|---|---|
| (SEQ ID NO: 245) | WP_018914915.1 | 517744707 | *Thiomonas* sp. FB-6 | HIBADHts |
| (SEQ ID NO: 246) | WP_022530055.1 | 548582704 | *Lactobacillus shenzhenensis* | HIBADHls |
| ABAZ39_23055 (SEQ ID NO: 247) | EZQ03930.1 | 612167293 | *Azospirillum brasilense* | HIBADHab |
| (SEQ ID NO: 248) | EMI09340.1 | 460132162 | *Anoxybacillus* sp. DT3-1 | HIBADHas |
| T458_21320 (SEQ ID NO: 249) | EST53365.1 | 558617142 | *Brevibacillus panacihumi* W25 | HIBADHbp |
| xcc-b100_3039 (SEQ ID NO: 250) | CAP52402.1 | 167734194 | *Xanthomonas campestris* pv. *campestris* | HIBADHxc |
| Bcenmc03_3479 (SEQ ID NO: 251) | ACA92632.1 | 169818050 | *Burkholderia cenocepacia* MC0-3 | HIBADHbcm |
| Hoch_3369 (SEQ ID NO: 252) | ACY15871.1 | 262079902 | *Haliangium ochraceum* DSM 14365 | HIBADHho |
| mmsB (SEQ ID NO: 253) | ADP96674.1 | 311693801 | *Marinobacter adhaerens* HP15 | HIBADHma |
| ivdF (SEQ ID NO: 254) | AAN54737.1 | 24347484 | *Shewanella oneidensis* MR-1 | HIBADHso |

TABLE 9

HBDH

| Gene | GenBank Accession No. (Amino Acid Sequences) | GI No. | Organism | Abbreviation |
|---|---|---|---|---|
| gbd (SEQ ID NO: 255) | AAC41425.1 | 695279 | *Cupriavidus necator* | HBDHcn |
| 4hbD (SEQ ID NO: 256) | EDK35022.1 | 146348486 | *Clostridium kluyveri* DSM 555 | HBDHck |
| GOS_1589287 (SEQ ID NO: 257) | EDB80735.1 | 142959799 | marine metagenome sp. | HBDHmm |
| HMPREF0080_00276 (SEQ ID NO: 258) | EHM43401.1 | 364565684 | *Anaeroglobus geminatus* F0357 | HBDHag |
| BN605_01179 (SEQ ID NO: 259) | CDD07748.1 | 524585315 | *Dorea* sp. CAG: 317 | HBDHds |
| BN791_01127 (SEQ ID NO: 260) | CDE92329.1 | 524795667 | *Fusobacterium* sp. CAG: 815 | HBDHfs |
| Odosp_2059 (SEQ ID NO: 261) | ADY33063.1 | 324312510 | *Odoribacter splanchnicus* DSM 220712 | HBDHos |
| Bpro_2526 (SEQ ID NO: 262) | ABE44443.1 | 91697614 | *Polaromonas* sp. JS666 | HBDHps |
| Csal_1756 (SEQ ID NO: 263) | ABE59108.1 | 91796969 | *Chromohalobacter salexigens* DSM 3043 | HBDHcs |
| BRPE64_DCDS02300 (SEQ ID NO: 264) | BAN27166.1 | 506947049 | *Burkholderia* sp. RPE64 | HBDHbs |

TABLE 10

BDH

| Gene | GenBank Accession No. (Amino Acid Sequences) | GI No. | Organism | Abbreviation |
|---|---|---|---|---|
| bdhA (SEQ ID NO: 265) | GAA17557.1 | 346057674 | *Pseudomonas aeruginosa* NCMG1179 | BDHpa |
| Bresu_2563 (SEQ ID NO: 266) | YP_003819493.1 | 302383670 | *Brevundimonas subvibrioides* ATCC 15264 | BDHbs |
| (SEQ ID NO: 267) | YP_004110707.1 | 316935725 | *Rhodopseudomonas palustris* DX-1 | BDHrp |

TABLE 10-continued

BDH

| Gene | GenBank Accession No. (Amino Acid Sequences) | GI No. | Organism | Abbreviation |
|---|---|---|---|---|
| (SEQ ID NO: 268) | WP_008960707.1 | 496247322 | *Bradyrhizobium* sp. STM 3809 | BDHbss |
| (SEQ ID NO: 269) | WP_009158463.1 | 496449618 | *Thalassobium* sp. R2A62 | BDHts |
| (SEQ ID NO: 270) | WP_010548788.1 | 498234632 | gamma proteobacterium HIMB30 | BDHgp |
| (SEQ ID NO: 271) | WP_018183273.1 | 516955964 | *Kaistia granuli* | BDHkg |
| h16_A1334 (SEQ ID NO: 272) | CAJ92474.1 | 113526129 | *Ralstonia eutropha* H16 | BDHre |
| bdhA (SEQ ID NO: 273) | EOY63580.1 | 509564889 | *Klebsiella pneumoniae* KP-7 | BDHkp |
| AZOBR_p140023 (SEQ ID NO: 274) | CCD00057.1 | 356879155 | *Azospirillum brasilense* Sp245 | BDHab |
| bdhA (SEQ ID NO: 275) | ABF07432.1 | 93353343 | *Cupriavidus metallidurans* CH34 | BDHcm |

In a specific embodiment of the present invention, the recombinant yeast comprising an active 3-HP biosynthetic pathway could have genes listed in Table 11, such as an exogenous gene encoding AADH having an amino acid sequence selected from the group consisting of SEQ ID NOs: 74 to 98, an endo- or exo-genous gene encoding ACC having an amino acid sequence selected from the group consisting of SEQ ID NOs: 99 to 106, an exogenous gene encoding MCR having an amino acid sequence selected from the group consisting of SEQ ID NOs: 107 to 116, and an exogenous gene encoding HPDH having an amino acid sequence selected from the group consisting of SEQ ID NOs: 117 to 144.

TABLE 11

| Type | Gene Abbreviation | SEQ ID NOs. |
|---|---|---|
| AADHs | AADHab | SEQ ID NO: 74 |
| | AADHal | SEQ ID NO: 75 |
| | AADHbs | SEQ ID NO: 76 |
| | AADHbw | SEQ ID NO: 77 |
| | AADHcs | SEQ ID NO: 78 |
| | AADHho | SEQ ID NO: 79 |
| | AADHhs | SEQ ID NO: 80 |
| | AADHma1 | SEQ ID NO: 81 |
| | AADHma2 | SEQ ID NO: 82 |
| | AADHmm | SEQ ID NO: 83 |
| | AADHpa | SEQ ID NO: 84 |
| | AADHpb | SEQ ID NO: 85 |
| | AADHpe | SEQ ID NO: 86 |
| | AADHrw | SEQ ID NO: 87 |
| | AADHsl | SEQ ID NO: 88 |
| | AADHss | SEQ ID NO: 89 |
| | AADHta | SEQ ID NO: 90 |
| | AADHtl | SEQ ID NO: 91 |
| | AADHtm | SEQ ID NO: 92 |
| | AADHvs | SEQ ID NO: 93 |
| | ADHEec | SEQ ID NO: 94 |
| | AHEpm | SEQ ID NO: 95 |
| | EUTEdz | SEQ ID NO: 96 |
| | EUTEec | SEQ ID NO: 97 |
| | LIN1129li | SEQ ID NO: 98 |
| ACC1s | ACC1sc_S659A | SEQ ID NO: 99 |
| | ACC1sc_S659A/S1157A | SEQ ID NO: 100 |
| | ACC1sc_S1157A | SEQ ID NO: 101 |
| | ACC1ke | SEQ ID NO: 102 |
| | ACC1mc | SEQ ID NO: 103 |
| | ACC1sc | SEQ ID NO: 104 |
| | ACCyl | SEQ ID NO: 105 |
| | ACC1ch | SEQ ID NO: 106 |
| bifunctional HPDH-MCRs | HPDH-MCRbs | SEQ ID NO: 107 |
| | HPDH-MCRca | SEQ ID NO: 108 |
| | HPDH-MCRcag | SEQ ID NO: 109 |
| | HPDH-MCRct | SEQ ID NO: 110 |
| | HPDH-MCRgb | SEQ ID NO: 111 |
| | HPDH-MCRot | SEQ ID NO: 112 |
| | HPDH-MCRrc | SEQ ID NO: 113 |
| | HPDH-MCRsl | SEQ ID NO: 114 |
| | HPDH-MCRca_variant_3 | SEQ ID NO: 115 |
| | HPDH-MCRca_variant_6 | SEQ ID NO: 116 |
| HPDHs | BDHcm | SEQ ID NO: 117 |
| | BDHkp | SEQ ID NO: 118 |
| | HBDHos | SEQ ID NO: 119 |
| | HBDHps | SEQ ID NO: 120 |
| | HIBADHas | SEQ ID NO: 121 |
| | HIBADHbc | SEQ ID NO: 122 |
| | HIBADHma | SEQ ID NO: 123 |
| | HIBADHpa | SEQ ID NO: 124 |
| | HIBADHxc | SEQ ID NO: 125 |
| | HPDHam | SEQ ID NO: 126 |
| | HPDHbs | SEQ ID NO: 127 |
| | HPDHca | SEQ ID NO: 128 |
| | HPDHcag | SEQ ID NO: 129 |
| | HPDHct | SEQ ID NO: 130 |
| | HPDHec | SEQ ID NO: 131 |
| | HPDHed | SEQ ID NO: 132 |
| | HPDHgb | SEQ ID NO: 133 |
| | HPDHhw | SEQ ID NO: 134 |
| | HPDHka | SEQ ID NO: 135 |
| | HPDHms | SEQ ID NO: 136 |
| | HPDHot | SEQ ID NO: 137 |
| | HPDHps | SEQ ID NO: 138 |
| | HPDHra | SEQ ID NO: 139 |
| | HPDHrc | SEQ ID NO: 140 |
| | HPDHsi | SEQ ID NO: 141 |
| | HPDHsl | SEQ ID NO: 142 |
| | HPDHsm | SEQ ID NO: 143 |
| | HPDHst | SEQ ID NO: 144 |

In the present invention, the yeast could be acid-resistant, and said acid-resistant yeast could be selected from the group consisting of for example the genera *Saccharomyces*, *Kazachstania* and *Candida*. Yeast species of particular interest include *Saccharomyces cerevisiae*, *Kazachstania exigua*, *Kazachstania bulderi*, and *Candida humilis*, but is not limited thereto.

According to the present invention, the recombinant yeast might be acid-resistant, and in order to prepare acid-resistant recombinant yeast, it is preferable to use yeast host having acid-resistant against organic acid (especially 3-HP and/or organic acid produced as a side product when preparing 3-HP).

The acid-resistant yeast might be selected from the group consisting of *Saccharomyces cerevisiae, Kazachstania exigua, Kazachstania bulderi* and *Candida humilis*, but not limited thereto.

The term "acid-resistant yeast" used in the specification refers to yeast having acid-resistant against organic acids such as 3-HP or the like, and acid-resistance could be evaluated by confirming the growth on medium containing various concentrations of organic acid. In this case, "acid-resistant yeast" might be yeast showing high growth rate and rate of consuming biomass when grown in medium containing high concentration of organic acid, compared to general yeast.

Acid-resistant yeast, according to the present invention, might be yeast that could maintain at least 10% of rate of consuming glucose (or the like) or at least 10% of specific growth rate in the medium containing more than 1M or more organic acid (particularly 3-HP) under pH less than pKa value of organic acid (particularly 3-HP), compared to yeast grown in the medium not containing organic acid. Acid-resistant yeast, according to the present invention, might be yeast that could maintain at least 10% of rate of consuming glucose (or the like) or at least 10% of specific growth rate under pH 2-4, compared to pH 7.

The genetically modified microorganism according to the present invention could be prepared by inserting a gene to a chromosome of a microorganism or introducing a modified vector into a microorganism.

A host where introduction efficiency of DNA is high and expression efficiency of introduced DNA is high is commonly used as said modified microorganism, and in one exemplary embodiment of the present invention, yeast is used, but is not limited thereto, any kind of microorganism could be used as long as sufficiently expressing targeted DNA.

Said modified microorganism could be prepared by any transformation method. "Transformation" means introducing DNA into a host; thereby DNA is able to be replicated, as a factor of chromosome or by integrating chromosome, which is a phenomenon artificially causing a genetic change. In common transformation methods, there are electroporation, acetic acid lithium-PEG method, and the like.

In addition, in the present invention, any generally well-known genetic engineering method could be used as a method for introducing a gene into a chromosome of a host microbe, and as an example, there is a method which uses retrovirus vector, adenovirus vector, adeno-associated virus vector, herpes simplex virus vector, poxvirus vector, lentivirus vector, non-viral vector, etc. "Vector" means a DNA construct comprising a DNA sequence to be operably linked to a suitable control sequence that can express DNA inside a host. A vector may be a plasmid, a phage particle, or simply a latent genomic insert. When a vector is transformed into a suitable host, it may be replicated or functional regardless of a host genome, or in some cases, it may be integrated into a genome itself. A plasmid is the type that is most generally used as a vector.

A typical plasmid vector that can be used for the object has a structure comprising (a) a replication origin that allows a replication to be effectively performed to include plasmid vectors per host cell, (b) an antibiotic-resistance gene or an auxotrophic marker gene that allows a host cell transformed with a plasmid vector to be selected, and (c) a restriction site of restriction enzyme that can be inserted with a foreign DNA fragment. Even if there is no suitable restriction site of a restriction enzyme, a vector and foreign DNA may be easily ligated when using the linker or the synthetic oligonucleotide adaptor according to a general method.

Nucleic acid is "operably linked" when it is arranged with a functional relationship with other nucleic acid sequences. It may be a gene and control sequence(s) that is linked in a process that enables the gene expression when a proper molecule (for example, transcriptional activation protein) is linked to the control sequence(s). For example, DNA for a pre-sequence or a secretion leader is operably linked to DNA for a polypeptide when expressing a pre-protein participating in secretion of a polypeptide; a promoter or an enhancer is operably linked to a coding sequence when affecting transcription of a sequence; a ribosome binding domain is operably linked to a coding sequence when affecting transcription of a sequence; or a ribosome binding domain is operably linked to a coding sequence when it is arranged to be easily translated.

Generally, "operably linked" refers to a contact of a linked DNA sequence, or that the secretion leader is contacted and presented in the leading frame. However, the enhancer is not required to contact. Linkage of enhancer sequence is performed by ligation at a convenient restriction enzyme site. When the domain is not presented, a synthetic oligonucleotide adaptor or linker according to a general method is used.

Of course, it should be understood that all the vectors do not function equally to express the DNA sequences according to the present invention. Likewise, all the host cells do not function equally for the same expression system. However, those skilled in the art may properly select a vector, expression control sequence and host cell without departing from the scope of the present invention and without undue experimentation. For example, in selection of a vector, a host cell must be considered. This is because the vector should be replicated therein. Also, the replication number and the ability to control the replication number of a vector and expression of other proteins encoded by the vector, for example, antibiotic marker, should be considered.

In another aspect, the present invention is directed to a method of preparing 3-HP comprising: (a) culturing the recombinant yeast of any one of claims 1 to 10 in a medium including at least one carbon source, thereby producing 3-HP; and (b) isolating the 3-HP from the culture.

In the present invention, the carbon source could be one or more selected from the group consisting of glucose, xylose, arabinose, sucrose, fructose, cellulose, glucose oligomers and glycerol, but is not limited thereto.

In the present invention, culturing is performed preferably under a condition that microbes such as *E. coli* does not work (e.g. producing metabolite etc.) anymore. In an embodiment, culturing is performed at pH 1.0 to 6.5, preferably at pH 1.0 to 6.0, more preferably at pH 2.6 to 4.0, but is not limited thereto.

MODE FOR THE INVENTION

Hereinafter, the present invention will be described in more detail with reference to the following Examples. However, the following Examples are provided by way of example so as to easily explain description and scope of the technical spirit of the present invention. Accordingly, the scope of the present invention is not restricted thereby or changed therefrom. In addition, various modifications and changes may be made by those skilled in the art to which the present invention pertains from this description.

Example 1: Selection of Host Yeast Strains Based on Tolerance to 3-HP

An essential feature of a 3-HP production organism is good tolerance to high concentrations of 3-HP, which enables product accumulation during fermentation with minimal loss of strain performance. A large, diverse set of 718 wild-type yeast strains were screened to identify those strains that can tolerate high concentrations of 3-HP at low pH and that can grow and metabolize glucose under these conditions (Table 12).

A number of agar plate and liquid medium microtitre plate based growth assays were initially used to screen the entire set of strains for acid tolerance. Afterwards, a subset of strains were evaluated for their ability to tolerate high amounts of 3-HP at low pH in shake flask cultivations. In isolation, none of these screening approaches is a perfect indicator of 3-HP tolerance in an industrial setting, but a combination of numerous approaches provides a thorough and robust means of establishing promising 3-HP producing yeast strains.

Initially, the growth of the 718 yeast strains was evaluated on solid YPD-based agar medium containing varying amounts of 3-HP: 0 g/L 3-HP (pH 6.62), 50 g/L 3-HP (pH 3.44), 75 g/L 3-HP (pH 3.28), 100 g/L 3-HP (pH 3.17) and 125 g/L 3-HP (pH 3.08). The strains were then scored based on their ability to tolerate the varying amounts of 3-HP in this screening assay.

Growth of the 718 yeast strains was then evaluated in the absence (SCD-based medium, 0 g/L 3-HP, pH 6.0) or presence (SCD-based medium, 70 g/L 3-HP, pH 3.5) of 3-HP in microtitre plate liquid cultures using Bioscreen C machines which can automatically incubate, shake and measure the turbidity of the cultures. Existing software for modeling microbial growth curves was then adapted to establish the lag phase, maximal growth rate and final cell density for each strain at each of the experimental conditions. For this screening assay, each strain was scored based on its maximum growth rate in the absence of 3-HP, its maximum growth rate in the presence of 3-HP and the relative difference between these two maximum growth rate values.

Using a liquid handling robot, the growth and glucose utilization rates of the 718 yeast strains were evaluated in YPD-based liquid medium containing 85 g/L 3-HP (pH 3.5) in microtitre plates. An automated work-flow was used to inoculate growth plates, to dilute samples for OD measurement at designated time-points and to centrifuge and collect supernatants for HPLC analysis which was used to measure the residual glucose amounts at designated time-points. In contrast to the Bioscreen C growth assays, the robotic microtitre plate growth assay allowed for more aeration and higher maximum cell densities to be achieved while also allowing for glucose utilization rates to be evaluated instead of just evaluating growth rate like the previous two assays. For this screening assay, each strain was scored based on their maximum cell density obtained in the presence of 3-HP and their ability to consume glucose in the presence of 3-HP at low pH.

The individual scores from the various evaluative 3-HP tolerance assays were averaged together to obtain the final 3-HP tolerance score for each of the strains (Table 12). These screens indicated that the yeast species *Candida apicola, Candida humilis, Issatchenkia orientalis, Kazachstania bulderi, Kazachstania exigua, Pichia membranifaciens, Saccharomyces cerevisiae* and *Yarrowia lipolytica* had good general tolerance to 3-HP at low pH under varying conditions.

These eight 3-HP tolerant yeast species were then further analyzed for their tolerance to 3-HP at low pH in shake flask cultivations. For these cultivations (defined SCD-based medium, high initial biomass, low aeration), the strain's ability to grow, consume glucose and produce ethanol was evaluated in the presence of varying levels of 3-HP at varying pHs: 100 g/L 3-HP (pH 4.0), 100 g/L 3-HP (pH 3.5), 100 g/L 3-HP (pH 3.0) and 80 g/L 3-HP (pH 2.6). These shake flask cultivations revealed that certain *C. humilis, K. bulderi, K. exigua* and *S. cerevisiae* yeast strains have very robust tolerance to high levels of 3-HP at low pH as they had the fastest glucose utilization rates, biomass production rates and ethanol production rates amongst the various yeast strains under these harsh conditions. On the other hand, the *C. apicola, I. orientalis, P. membranifaciens* and *Y. lipolytica* yeast strains were unable to perform well under these very restrictive growth conditions. These detailed follow-up analyses using various shake flask cultivations confirmed that certain *C. humilis, K. bulderi, K. exigua* and *S. cerevisiae* yeast strains show great potential as 3-HP production hosts as they exhibit a high natural tolerance to 3-HP under industrially relevant conditions.

TABLE 12

Yeast strain tolerance to 3-HP

| Yeast Strain | Yeast Species | Average Score |
|---|---|---|
| VSK-1 | *Saccharomyces pastorianus* | 1.54 |
| VSK-2 | *Saccharomyces cerevisiae* | 1.38 |
| VSK-3 | *Saccharomyces cerevisiae* | 1.03 |
| VSK-4 | *Saccharomyces cerevisiae* | 0.83 |
| VSK-5 | *Saccharomyces cerevisiae* | 1.71 |
| VSK-6 | *Saccharomyces pastorianus* | 1.57 |
| VSK-7 | *Saccharomyces pastorianus* | 3.79 |
| VSK-8 | *Saccharomyces pastorianus* | 0.63 |
| VSK-9 | *Saccharomyces pastorianus* | 1.58 |
| VSK-10 | *Saccharomyces pastorianus* | 0.08 |
| VSK-11 | *Saccharomyces pastorianus* | 1.67 |
| VSK-12 | *Saccharomyces pastorianus* | 1.65 |
| VSK-13 | *Saccharomyces pastorianus* | 1.24 |
| VSK-14 | *Saccharomyces pastorianus* | 1.54 |
| VSK-15 | *Saccharomyces pastorianus* | 1.04 |
| VSK-16 | *Saccharomyces pastorianus* | 1.46 |
| VSK-17 | *Saccharomyces pastorianus* | 1.17 |
| VSK-18 | *Saccharomyces pastorianus* | 1.17 |
| VSK-19 | *Saccharomyces pastorianus* | 1.28 |
| VSK-20 | *Saccharomyces pastorianus* | 1.53 |
| VSK-21 | *Saccharomyces pastorianus* | 0.67 |
| VSK-22 | *Saccharomyces pastorianus* | 0.58 |
| VSK-23 | *Saccharomyces cerevisiae* | 1.67 |
| VSK-24 | *Saccharomyces cerevisiae* | 2.13 |
| VSK-25 | *Saccharomyces pastorianus* | 1.97 |
| VSK-26 | *Saccharomyces pastorianus* | 3.89 |
| VSK-27 | *Saccharomyces pastorianus* | 1.44 |
| VSK-28 | *Saccharomyces pastorianus* | 0.61 |
| VSK-29 | *Saccharomyces pastorianus* | 1.44 |
| VSK-30 | *Saccharomyces pastorianus* | 1.64 |
| VSK-31 | *Saccharomyces pastorianus* | 1.25 |
| VSK-32 | *Saccharomyces pastorianus* | 1.49 |
| VSK-33 | *Saccharomyces pastorianus* | 1.78 |
| VSK-34 | *Saccharomyces pastorianus* | 1.36 |
| VSK-35 | *Saccharomyces pastorianus* | 1.36 |
| VSK-36 | *Saccharomyces pastorianus* | 1.39 |
| VSK-37 | *Saccharomyces pastorianus* | 1.47 |
| VSK-38 | *Saccharomyces cerevisiae* | 3.82 |
| VSK-39 | *Saccharomyces pastorianus* | 1.22 |
| VSK-40 | *Saccharomyces pastorianus* | 1.31 |
| VSK-41 | *Saccharomyces pastorianus* | 3.13 |
| VSK-42 | *Saccharomyces pastorianus* | 1.44 |
| VSK-43 | *Saccharomyces pastorianus* | 1.44 |

TABLE 12-continued

Yeast strain tolerance to 3-HP

| Yeast Strain | Yeast Species | Average Score |
|---|---|---|
| VSK-44 | Saccharomyces pastorianus | 1.36 |
| VSK-45 | Saccharomyces pastorianus | 1.28 |
| VSK-46 | Saccharomyces pastorianus | 1.57 |
| VSK-47 | Saccharomyces pastorianus | 1.32 |
| VSK-48 | Saccharomyces pastorianus | 0.44 |
| VSK-49 | Saccharomyces pastorianus | 1.18 |
| VSK-50 | Saccharomyces cerevisiae | 1.61 |
| VSK-51 | Saccharomyces pastorianus | 1.86 |
| VSK-52 | Saccharomyces pastorianus | 0.94 |
| VSK-53 | Saccharomyces pastorianus | 1.11 |
| VSK-54 | Saccharomyces pastorianus | 1.53 |
| VSK-55 | Saccharomyces pastorianus | 1.36 |
| VSK-56 | Saccharomyces pastorianus | 0.63 |
| VSK-57 | Saccharomyces pastorianus | 0.81 |
| VSK-58 | Saccharomyces pastorianus | 0.25 |
| VSK-59 | Saccharomyces pastorianus | 1.44 |
| VSK-60 | Saccharomyces pastorianus | 1.31 |
| VSK-61 | Saccharomyces pastorianus | 1.40 |
| VSK-62 | Saccharomyces pastorianus | 2.43 |
| VSK-63 | Saccharomyces pastorianus | 1.44 |
| VSK-64 | Saccharomyces cerevisiae | 2.42 |
| VSK-65 | Saccharomyces cerevisiae | 2.49 |
| VSK-66 | Saccharomyces pastorianus | 3.42 |
| VSK-67 | Saccharomyces cerevisiae | 2.78 |
| VSK-68 | Saccharomyces pastorianus | 0.86 |
| VSK-69 | Saccharomyces pastorianus | 0.65 |
| VSK-70 | Saccharomyces pastorianus | 2.57 |
| VSK-71 | Saccharomyces pastorianus | 1.58 |
| VSK-72 | Saccharomyces pastorianus | 1.19 |
| VSK-73 | Saccharomyces pastorianus | 1.33 |
| VSK-74 | Saccharomyces cerevisiae | 2.71 |
| VSK-75 | Saccharomyces pastorianus | 1.17 |
| VSK-76 | Saccharomyces pastorianus | 0.83 |
| VSK-77 | Saccharomyces pastorianus | 0.79 |
| VSK-78 | Saccharomyces cerevisiae | 1.46 |
| VSK-79 | Saccharomyces cerevisiae | 1.13 |
| VSK-80 | Saccharomyces cerevisiae | 1.25 |
| VSK-81 | Saccharomyces cerevisiae | 1.97 |
| VSK-82 | Saccharomyces cerevisiae | 1.65 |
| VSK-83 | Saccharomyces cerevisiae | 2.72 |
| VSK-84 | Saccharomyces cerevisiae | 1.74 |
| VSK-85 | Saccharomyces cerevisiae | 2.47 |
| VSK-86 | Saccharomyces cerevisiae | 3.00 |
| VSK-87 | Saccharomyces cerevisiae | 3.40 |
| VSK-88 | Saccharomyces cerevisiae | 2.13 |
| VSK-89 | Saccharomyces pastorianus | 1.25 |
| VSK-90 | Saccharomyces pastorianus | 1.13 |
| VSK-91 | Saccharomyces pastorianus | 2.00 |
| VSK-92 | Saccharomyces pastorianus | 3.01 |
| VSK-93 | Saccharomyces pastorianus | 2.38 |
| VSK-94 | Saccharomyces cerevisiae | 3.11 |
| VSK-95 | Saccharomyces cerevisiae | 3.10 |
| VSK-96 | Saccharomyces cerevisiae | 3.10 |
| VSK-97 | Saccharomyces cerevisiae | 3.26 |
| VSK-98 | Saccharomyces cerevisiae | 3.51 |
| VSK-99 | Saccharomyces cerevisiae | 3.63 |
| VSK-100 | Saccharomyces cerevisiae | 2.64 |
| VSK-101 | Saccharomyces cerevisiae | 2.69 |
| VSK-102 | Saccharomyces cerevisiae | 3.06 |
| VSK-103 | Saccharomyces cerevisiae | 3.01 |
| VSK-104 | Saccharomyces pastorianus | 1.44 |
| VSK-105 | Saccharomyces cerevisiae | 3.06 |
| VSK-106 | Saccharomyces cerevisiae | 1.72 |
| VSK-107 | Saccharomyces pastorianus | 1.39 |
| VSK-108 | Saccharomyces pastorianus | 1.44 |
| VSK-109 | Saccharomyces pastorianus | 1.97 |
| VSK-110 | Saccharomyces pastorianus | 1.74 |
| VSK-111 | Saccharomyces pastorianus | 2.72 |
| VSK-112 | Saccharomyces cerevisiae | 3.10 |
| VSK-113 | Saccharomyces cerevisiae | 3.39 |
| VSK-114 | Saccharomyces cerevisiae | 1.42 |
| VSK-115 | Saccharomyces pastorianus | 1.44 |
| VSK-116 | Saccharomyces cerevisiae | 3.51 |
| VSK-117 | Saccharomyces cerevisiae | 3.75 |
| VSK-118 | Saccharomyces bayanus | 3.42 |
| VSK-119 | Saccharomyces cerevisiae | 3.15 |
| VSK-120 | Saccharomyces cerevisiae | 2.32 |
| VSK-121 | Saccharomyces cerevisiae | 3.51 |
| VSK-122 | Saccharomyces cerevisiae | 3.11 |
| VSK-123 | Saccharomyces cerevisiae | 3.49 |
| VSK-124 | Saccharomyces cerevisiae | 2.96 |
| VSK-125 | Saccharomyces cerevisiae | 3.51 |
| VSK-126 | Saccharomyces cerevisiae | 0.97 |
| VSK-127 | Saccharomyces cerevisiae | 2.75 |
| VSK-128 | Saccharomyces cerevisiae | 3.68 |
| VSK-129 | Saccharomyces kudriavzevii | 2.61 |
| VSK-130 | Saccharomyces cerevisiae | 3.01 |
| VSK-131 | Saccharomyces cerevisiae | 3.35 |
| VSK-132 | Saccharomyces cerevisiae | 2.90 |
| VSK-133 | Saccharomyces cerevisiae | 3.07 |
| VSK-134 | Saccharomyces cerevisiae | 3.49 |
| VSK-135 | Saccharomyces cerevisiae | 0.75 |
| VSK-136 | Saccharomyces cerevisiae | 2.36 |
| VSK-137 | Saccharomyces cerevisiae | 2.83 |
| VSK-138 | Saccharomyces bayanus | 1.61 |
| VSK-139 | Saccharomyces cerevisiae | 3.07 |
| VSK-140 | Saccharomyces cerevisiae | 3.35 |
| VSK-141 | Saccharomyces cerevisiae | 2.75 |
| VSK-142 | Saccharomyces cerevisiae | 3.04 |
| VSK-143 | Saccharomyces bayanus | 1.43 |
| VSK-144 | Saccharomyces sp. | 3.11 |
| VSK-145 | Saccharomyces sp. | 3.28 |
| VSK-146 | Saccharomyces sp. | 1.89 |
| VSK-147 | Saccharomyces cerevisiae | 3.25 |
| VSK-148 | Saccharomyces cerevisiae | 3.01 |
| VSK-149 | Saccharomyces bayanus | 3.38 |
| VSK-150 | Saccharomyces cerevisiae | 3.22 |
| VSK-151 | Saccharomyces cerevisiae | 2.75 |
| VSK-152 | Saccharomyces cerevisiae | 3.13 |
| VSK-153 | Saccharomyces cerevisiae | 0.08 |
| VSK-154 | Saccharomyces cerevisiae | 2.46 |
| VSK-155 | Saccharomyces cerevisiae | 3.38 |
| VSK-156 | Saccharomyces cerevisiae | 3.06 |
| VSK-157 | Saccharomyces cerevisiae | 2.00 |
| VSK-158 | Saccharomyces pastorianus | 2.75 |
| VSK-159 | Saccharomyces cerevisiae | 1.10 |
| VSK-160 | Saccharomyces cerevisiae | 1.83 |
| VSK-161 | Saccharomyces bayanus | 3.15 |
| VSK-162 | Saccharomyces cerevisiae | 1.79 |
| VSK-163 | Saccharomyces cerevisiae | 2.47 |
| VSK-164 | Saccharomyces cerevisiae | 2.43 |
| VSK-165 | Saccharomyces bayanus | 1.67 |
| VSK-166 | Saccharomyces cerevisiae | 2.90 |
| VSK-167 | Saccharomyces cerevisiae | 2.86 |
| VSK-168 | Saccharomyces cerevisiae | 2.17 |
| VSK-169 | Saccharomyces cerevisiae | 2.76 |
| VSK-170 | Saccharomyces cerevisiae | 3.46 |
| VSK-171 | Saccharomyces cerevisiae | 3.65 |
| VSK-172 | Saccharomyces cerevisiae | 3.89 |
| VSK-173 | Saccharomyces cerevisiae | 3.11 |
| VSK-174 | Saccharomyces cerevisiae | 3.61 |
| VSK-175 | Saccharomyces cerevisiae | 2.67 |
| VSK-176 | Saccharomyces cerevisiae | 2.67 |
| VSK-177 | Saccharomyces cerevisiae | 1.88 |
| VSK-178 | Saccharomyces cerevisiae | 3.56 |
| VSK-179 | Saccharomyces cerevisiae | 3.82 |
| VSK-180 | Saccharomyces cerevisiae | 2.54 |
| VSK-181 | Saccharomyces cerevisiae | 3.64 |
| VSK-182 | Saccharomyces cerevisiae | 3.07 |
| VSK-183 | Saccharomyces cerevisiae | 3.32 |
| VSK-184 | Saccharomyces cerevisiae | 3.89 |
| VSK-185 | Saccharomyces cerevisiae | 1.96 |
| VSK-186 | Saccharomyces cerevisiae | 3.51 |
| VSK-187 | Saccharomyces cerevisiae | 3.39 |
| VSK-188 | Saccharomyces cerevisiae | 3.07 |
| VSK-189 | Saccharomyces cerevisiae | 3.71 |
| VSK-190 | Saccharomyces cerevisiae | 3.13 |
| VSK-191 | Saccharomyces pastorianus | 2.04 |
| VSK-192 | Saccharomyces cerevisiae | 3.14 |
| VSK-193 | Saccharomyces cerevisiae | 3.99 |
| VSK-194 | Saccharomyces cerevisiae | 3.53 |
| VSK-195 | Saccharomyces cerevisiae | 3.90 |

TABLE 12-continued

Yeast strain tolerance to 3-HP

| Yeast Strain | Yeast Species | Average Score |
|---|---|---|
| VSK-196 | Saccharomyces cerevisiae | 3.46 |
| VSK-197 | Saccharomyces cerevisiae | 2.99 |
| VSK-198 | Saccharomyces cerevisiae | 4.11 |
| VSK-199 | Saccharomyces cerevisiae | 3.93 |
| VSK-200 | Saccharomyces cerevisiae | 3.40 |
| VSK-201 | Saccharomyces cerevisiae | 1.83 |
| VSK-202 | Saccharomyces cerevisiae | 2.96 |
| VSK-203 | Saccharomyces cerevisiae | 2.64 |
| VSK-204 | Saccharomyces cerevisiae | 2.28 |
| VSK-205 | Saccharomyces cerevisiae | 3.42 |
| VSK-206 | Saccharomyces cerevisiae | 3.17 |
| VSK-207 | Saccharomyces cerevisiae | 3.13 |
| VSK-208 | Saccharomyces cerevisiae | 3.69 |
| VSK-209 | Saccharomyces cerevisiae | 3.64 |
| VSK-210 | Issatchenkia orientalis | 3.07 |
| VSK-211 | Issatchenkia orientalis | 2.40 |
| VSK-212 | Issatchenkia orientalis | 2.44 |
| VSK-213 | Issatchenkia orientalis | 2.60 |
| VSK-214 | Issatchenkia orientalis | 2.85 |
| VSK-215 | Issatchenkia orientalis | 2.35 |
| VSK-216 | Issatchenkia orientalis | 3.04 |
| VSK-217 | Zygosaccharomyces kombuchaensis | 0.67 |
| VSK-218 | Candida glabrata | 3.67 |
| VSK-219 | Candida glabrata | 3.38 |
| VSK-220 | Kazachstania exigua | 3.89 |
| VSK-221 | Kazachstania exigua | 3.89 |
| VSK-222 | Issatchenkia orientalis | 2.01 |
| VSK-223 | Issatchenkia orientalis | 3.13 |
| VSK-224 | Issatchenkia orientalis | 2.60 |
| VSK-225 | Kazachstania exigua | 3.26 |
| VSK-226 | Pichia membranifaciens | 3.11 |
| VSK-227 | Pichia membranifaciens | 3.18 |
| VSK-228 | Pichia membranifaciens | 2.76 |
| VSK-229 | Pichia membranifaciens | 3.26 |
| VSK-230 | Pichia membranifaciens | 3.35 |
| VSK-231 | Pichia membranifaciens | 3.13 |
| VSK-232 | Pichia membranifaciens | 3.06 |
| VSK-233 | Pichia membranifaciens | 3.18 |
| VSK-234 | Pichia membranifaciens | 2.56 |
| VSK-235 | Kazachstania exigua | 4.13 |
| VSK-236 | Saccharomycodes ludwigii | 2.94 |
| VSK-237 | Zygosaccharomyces kombuchaensis | 3.18 |
| VSK-238 | Zygosaccharomyces kombuchaensis | 2.96 |
| VSK-239 | Candida glabrata | 3.49 |
| VSK-240 | Candida glabrata | 1.61 |
| VSK-241 | Issatchenkia orientalis | 2.79 |
| VSK-242 | Kazachstania bulderi | 3.38 |
| VSK-243 | Kazachstania bulderi | 3.60 |
| VSK-244 | Candida magnoliae | 3.08 |
| VSK-245 | Issatchenkia orientalis | 1.63 |
| VSK-246 | Kazachstania bulderi | 3.44 |
| VSK-247 | Issatchenkia orientalis | 0.00 |
| VSK-248 | Issatchenkia orientalis | 3.08 |
| VSK-249 | Issatchenkia orientalis | 3.07 |
| VSK-250 | Kazachstania exigua | 3.00 |
| VSK-251 | Candida glabrata | 2.49 |
| VSK-252 | Issatchenkia orientalis | 2.35 |
| VSK-253 | Kazachstania exigua | 2.33 |
| VSK-254 | Saccharomycodes ludwigii | 2.43 |
| VSK-255 | Issatchenkia orientalis | 2.68 |
| VSK-256 | Kazachstania exigua | 3.56 |
| VSK-257 | Kazachstania exigua | 4.00 |
| VSK-258 | Issatchenkia orientalis | 2.24 |
| VSK-259 | Issatchenkia orientalis | 2.79 |
| VSK-260 | Issatchenkia orientalis | 2.53 |
| VSK-261 | Pichia burtonii | 0.42 |
| VSK-262 | Candida boidinii | 1.86 |
| VSK-263 | Pichia kluyveri | 1.56 |
| VSK-264 | Torulaspora delbrueckii | 3.19 |
| VSK-265 | Kazachstania servazzii | 2.40 |
| VSK-266 | Zygosaccharomyces rouxii | 1.15 |
| VSK-267 | Pichia fermentans | 2.00 |
| VSK-268 | Yarrowia lipolytica | 2.86 |
| VSK-269 | Candida boidinii | 2.46 |
| VSK-270 | Candida intermedia | 0.65 |
| VSK-271 | Candida parapsilosis | 1.58 |
| VSK-272 | Yarrowia lipolytica | 2.10 |
| VSK-273 | Candida parapsilosis | 2.24 |
| VSK-274 | Debaryomyces hansenii | 0.25 |
| VSK-275 | Pichia guilliermondii | 2.32 |
| VSK-276 | Kazachstania servazzii | 0.72 |
| VSK-277 | Rhodotorula glutinis | 0.72 |
| VSK-278 | Cryptococcus albidus | 0.74 |
| VSK-279 | Rhodosporidium toruloides | 0.67 |
| VSK-280 | Debaryomyces occidentalis | 1.17 |
| VSK-281 | Rhodotorula mucilaginosa | 1.54 |
| VSK-282 | Candida auringiensis | 1.58 |
| VSK-283 | Candida succiphila | 2.08 |
| VSK-284 | Ambrosiozyma monospora | 0.71 |
| VSK-285 | Candida arabinofermentans | 0.56 |
| VSK-286 | Kluyveromyces marxianus | 2.06 |
| VSK-287 | Lachancea thermotolerans | 2.28 |
| VSK-288 | Cryptococcus albidus | 0.25 |
| VSK-289 | Debaryomyces occidentalis | 1.76 |
| VSK-290 | Rhodotorula mucilaginosa | 2.85 |
| VSK-291 | Rhodotorula glutinis | 0.00 |
| VSK-292 | Zygosaccharomyces lentus | 0.33 |
| VSK-293 | Rhodosporidium toruloides | 0.38 |
| VSK-294 | Cryptococcus albidus | 0.00 |
| VSK-295 | Torulaspora globosa | 2.07 |
| VSK-296 | Candida stellata | 1.36 |
| VSK-297 | Cryptococcus laurentii | 0.53 |
| VSK-298 | Williopsis saturnus | 0.76 |
| VSK-299 | Cystofilobasidium bisporidii | 1.94 |
| VSK-300 | Cryptococcus curvatus | 1.78 |
| VSK-301 | Sporidiobolus salmonicolor | 2.17 |
| VSK-302 | Pichia jadinii | 0.86 |
| VSK-303 | Geotrichum klebahnii | 0.67 |
| VSK-304 | Cryptococcus laurentii | 0.19 |
| VSK-305 | Debaryomyces hansenii | 0.82 |
| VSK-306 | Yarrowia lipolytica | 1.36 |
| VSK-307 | Candida rugosa | 1.97 |
| VSK-308 | Candida pararugosa | 1.68 |
| VSK-309 | Debaryomyces occidentalis | 0.68 |
| VSK-310 | Arxula adeninivorans | 1.38 |
| VSK-311 | Pichia stipitis | 2.17 |
| VSK-312 | Cryptococcus albidus | 2.19 |
| VSK-313 | Candida haemulonii | 2.18 |
| VSK-314 | Debaryomyces hansenii | 0.38 |
| VSK-315 | Pichia angusta | 0.82 |
| VSK-316 | Rhodotorula minuta | 0.40 |
| VSK-317 | Pichia mandshurica | 1.03 |
| VSK-318 | Zygosaccharomyces bailii | 0.94 |
| VSK-319 | Cryptococcus albidosimilis | 0.44 |
| VSK-320 | Cryptococcus wieringae | 0.61 |
| VSK-321 | Filobasidium globisporum | 0.00 |
| VSK-322 | Filobasidium globisporum | 0.03 |
| VSK-323 | Bulleromyces albus | 0.39 |
| VSK-324 | Candida anglica | 0.56 |
| VSK-325 | Candida anglica | 0.65 |
| VSK-326 | Candida fermentati | 2.28 |
| VSK-327 | Candida natalensis | 0.76 |
| VSK-328 | Candida pararugosa | 1.08 |
| VSK-329 | Candida picinguabensis | 0.71 |
| VSK-330 | Candida silvae | 1.07 |
| VSK-331 | Candida solani | 0.63 |
| VSK-332 | Candida cylindracea | 1.22 |
| VSK-333 | Cryptococcus curvatus | 0.47 |
| VSK-334 | Cryptococcus macerans | 0.58 |
| VSK-335 | Cryptococcus macerans | 0.33 |
| VSK-336 | Cryptococcus magnus | 1.57 |
| VSK-337 | Cryptococcus magnus | 0.57 |
| VSK-338 | Cryptococcus victoriae | 0.74 |
| VSK-339 | Cryptococcus victoriae | 0.79 |
| VSK-340 | Cryptococcus wieringae | 1.19 |
| VSK-341 | Cryptococcus mycelialis | 0.33 |
| VSK-342 | Dioszegia hungarica | 2.01 |
| VSK-343 | Hanseniaspora sp. | 2.32 |
| VSK-344 | Hanseniaspora uvarum | 2.89 |
| VSK-345 | Pichia fabianii | 0.85 |
| VSK-346 | Rhodotorula pinicola | 0.36 |
| VSK-347 | Rhodotorula pinicola | 0.39 |

TABLE 12-continued

Yeast strain tolerance to 3-HP

| Yeast Strain | Yeast Species | Average Score |
|---|---|---|
| VSK-348 | Sporobolomyces ruberrimus | 0.50 |
| VSK-349 | Sporobolomyces roseus | 0.36 |
| VSK-350 | Williopsis californica | 0.60 |
| VSK-351 | Pichia pastoris | 0.64 |
| VSK-352 | Pichia pastoris | 1.01 |
| VSK-353 | Pichia pastoris | 0.96 |
| VSK-354 | Pichia mandshurica | 3.00 |
| VSK-355 | Pichia heedii | 1.26 |
| VSK-356 | Pichia punctispora | 3.32 |
| VSK-357 | Kazachstania unispora | 1.19 |
| VSK-358 | Schizosaccharomyces pombe | 3.49 |
| VSK-359 | Torulaspora delbrueckii | 0.36 |
| VSK-360 | Yarrowia lipolytica | 2.82 |
| VSK-361 | Yarrowia lipolytica | 2.14 |
| VSK-362 | Zygosaccharomyees bailii | 2.08 |
| VSK-363 | Zygosaccharomyces bailii | 2.39 |
| VSK-364 | Zygosaccharomyces bisporus | 0.58 |
| VSK-365 | Candida fluviatilis | 0.76 |
| VSK-366 | Saccharomycopsis capsularis | 0.68 |
| VSK-367 | Zygosaccharomyces rouxii | 2.51 |
| VSK-368 | Candida fluviatilis | 0.68 |
| VSK-369 | Candida humilis | 0.36 |
| VSK-370 | Candida catenulata | 0.47 |
| VSK-371 | Debaryomyces hansenii | 0.38 |
| VSK-372 | Pichia guilliermondii | 1.90 |
| VSK-373 | Candida intermedia | 0.74 |
| VSK-374 | Candida lactis-condensi | 0.78 |
| VSK-375 | Pichia fermentans | 1.22 |
| VSK-376 | Candida pignaliae | 0.60 |
| VSK-377 | Candida pseudolambica | 0.82 |
| VSK-378 | Candida rugosa | 2.69 |
| VSK-379 | Candida sorboxylosa | 2.33 |
| VSK-380 | Kregervanrija fluxuum | 0.28 |
| VSK-381 | Citeromyces matritensis | 0.60 |
| VSK-382 | Debaryomyces polymorphus | 1.11 |
| VSK-383 | Debaryomyces sp. | 1.46 |
| VSK-384 | Dekkera anomala | 0.75 |
| VSK-385 | Dekkera bruxellensis | 0.67 |
| VSK-386 | Dekkera bruxellensis | 0.44 |
| VSK-387 | Pichia burtonii | 0.64 |
| VSK-388 | Pichia burtonii | 0.64 |
| VSK-389 | Kluyveromyces yarrowii | 0.53 |
| VSK-390 | Kodamaea ohmeri | 2.15 |
| VSK-391 | Metschnikowia pulcherrima | 0.83 |
| VSK-392 | Eromothecium coryli | 0.71 |
| VSK-393 | Pichia anomala | 1.22 |
| VSK-394 | Kluyveromyces marxianus | 2.07 |
| VSK-395 | Saturnispora mendoncae | 0.61 |
| VSK-396 | Pichia minuta | 0.53 |
| VSK-397 | Pichia nakasei | 0.50 |
| VSK-398 | Pichia silvicola | 0.50 |
| VSK-399 | Pichia stipitis | 0.60 |
| VSK-400 | Pichia tannicola | 2.29 |
| VSK-401 | Pichia toletana | 0.00 |
| VSK-402 | Schizosaccharomyces japonicus | 0.17 |
| VSK-403 | Pichia haplophila | 0.46 |
| VSK-404 | Zygosaccharomyces bailii | 0.83 |
| VSK-405 | Zygosaccharomyces bisporus | 1.32 |
| VSK-406 | Bulleromyces albus | 0.00 |
| VSK-407 | Pseudozyma antarctica | 0.00 |
| VSK-408 | Pichia stipitis | 0.25 |
| VSK-409 | Cryptococcus wieringae | 0.08 |
| VSK-410 | Sporobolomyces ruberrimus | 3.10 |
| VSK-411 | Cryptococcus diffluens | 0.29 |
| VSK-412 | Cryptococcus curvatus | 0.33 |
| VSK-413 | Lipomyces tetrasporus | 0.46 |
| VSK-414 | Candida shehatae | 0.42 |
| VSK-415 | Lipomyces lipofer | 0.00 |
| VSK-416 | Lipomyces starkeyi | 0.00 |
| VSK-417 | Candida apis | 1.21 |
| VSK-418 | Candida sorbophila | 1.08 |
| VSK-419 | Candida oleophila | 0.75 |
| VSK-420 | Sporidiobolus salmonicolor | 0.50 |
| VSK-421 | Candida apicola | 1.79 |
| VSK-422 | Zygosaccharomyces lentus | 0.29 |
| VSK-423 | Candida saitoana | 0.33 |
| VSK-424 | Pichia guilliermondii | 1.86 |
| VSK-425 | Kluyveromyces lactis | 0.88 |
| VSK-426 | Pichia jadinii | 1.65 |
| VSK-427 | Metschnikowia pulcherrima | 1.50 |
| VSK-428 | Rhodosporidium toruloides | 0.29 |
| VSK-429 | Schizosaccharomyces japonicus | 1.29 |
| VSK-430 | Lachancea thermotolerans | 0.75 |
| VSK-431 | Candida saitoana | 0.71 |
| VSK-432 | Dekkera anomala | 0.42 |
| VSK-433 | Kluyveromyces marxianus | 1.69 |
| VSK-434 | Kluyveromyces marxianus | 1.17 |
| VSK-435 | Candida maltosa | 2.19 |
| VSK-436 | Pichia fabianii | 1.33 |
| VSK-437 | Candida viswanathii | 0.29 |
| VSK-438 | Candida catenulata | 0.42 |
| VSK-439 | Schizosaccharomyces pombe | 1.93 |
| VSK-440 | Kluyveromyces lactis | 0.29 |
| VSK-441 | Kazachstania unispora | 3.28 |
| VSK-442 | Kazachstania unispora | 3.24 |
| VSK-443 | Pachysolen tannophilus | 0.75 |
| VSK-444 | Pachysolen tannophilus | 0.92 |
| VSK-445 | Pichia subpelliculosa | 1.76 |
| VSK-446 | Trigonopsis variabilis | 1.44 |
| VSK-447 | Candida versatilis | 1.99 |
| VSK-448 | Pichia farinosa | 0.54 |
| VSK-449 | Pichia farinosa | 2.04 |
| VSK-450 | Kodamaea ohmeri | 2.25 |
| VSK-451 | Pichia triangularis | 2.08 |
| VSK-452 | Candida diddensiae | 2.17 |
| VSK-453 | Pichia quercuum | 1.96 |
| VSK-454 | Sporidiobolus johnsonii | 0.65 |
| VSK-455 | Debaryomyces coudertii | 0.67 |
| VSK-456 | Candida apicola | 2.33 |
| VSK-457 | Candida humilis | 4.25 |
| VSK-458 | Rhodotorula mucilaginosa | 0.29 |
| VSK-459 | Dekkera anomala | 0.33 |
| VSK-460 | Zygosaccharomyces bailii | 1.18 |
| VSK-461 | Rhodotorula glutinis | 0.33 |
| VSK-462 | Sporobolomyces roseus | 0.25 |
| VSK-463 | Pichia anomala | 2.21 |
| VSK-464 | Candida zeylanoides | 2.03 |
| VSK-465 | Zygosaccharomyces rouxii | 2.29 |
| VSK-466 | Pichia anomala | 2.17 |
| VSK-467 | Zygosaccharomyces bisporus | 0.42 |
| VSK-468 | Lachancea fermentati | 1.51 |
| VSK-469 | Zygosaccharomyces rouxii | 0.46 |
| VSK-470 | Torulaspora microellipsoides | 0.67 |
| VSK-471 | Zygotorulaspora florentinus | 1.61 |
| VSK-472 | Zygosaccharomyces mellis | 0.33 |
| VSK-473 | Lachancea cidri | 2.26 |
| VSK-474 | Zygotorulaspora mrakii | 2.18 |
| VSK-475 | Candida sake | 0.42 |
| VSK-476 | Candida silvae | 1.21 |
| VSK-477 | Sporopachydermia lactativora | 0.46 |
| VSK-478 | Sporopachydermia lactativora | 0.46 |
| VSK-479 | Clavispora lusitaniae | 0.88 |
| VSK-480 | Cryptococcus laurentii | 0.46 |
| VSK-481 | Clavispora lusitaniae | 0.63 |
| VSK-482 | Naumovia dairenensis | 0.63 |
| VSK-483 | Candida membranifaciens | 0.46 |
| VSK-484 | Candida tenuis | 0.46 |
| VSK-485 | Candida membranifaciens | 0.46 |
| VSK-486 | Cystofilobasidium infirmo-miniatum | 0.50 |
| VSK-487 | Candida oleophila | 1.08 |
| VSK-488 | Rhodotorula minuta | 0.42 |
| VSK-489 | Pichia farinosa | 2.29 |
| VSK-490 | Candida solani | 0.61 |
| VSK-491 | Candida sake | 0.63 |
| VSK-492 | Hanseniaspora uvarum | 2.21 |
| VSK-493 | Pichia angusta | 1.79 |
| VSK-494 | Candida entomophila | 0.50 |
| VSK-495 | Candida methanosorbosa | 0.46 |
| VSK-496 | Candida diddensiae | 0.42 |
| VSK-497 | Candida sonorensis | 1.50 |
| VSK-498 | Saccharomyces cerevisiae | 0.88 |
| VSK-499 | Zygosaccharomyces kombuchaensis | 1.10 |

TABLE 12-continued

Yeast strain tolerance to 3-HP

| Yeast Strain | Yeast Species | Average Score |
|---|---|---|
| VSK-500 | Candida mesenterica | 0.54 |
| VSK-501 | Pichia punctispora | 0.54 |
| VSK-502 | Pichia sp. | 1.63 |
| VSK-503 | Pichia sp. | 2.97 |
| VSK-504 | Saccharomyces paradoxus | 2.07 |
| VSK-505 | Pichia fermentans | 1.03 |
| VSK-506 | Kregervanrija fluxuum | 2.58 |
| VSK-507 | Zygosaccharomyces mellis | 1.46 |
| VSK-508 | Lachancea fermentati | 2.25 |
| VSK-509 | Cryptococcus liquefaciens | 0.17 |
| VSK-510 | Filobasidium capsuligenum | 0.36 |
| VSK-511 | Wickerhamomyces anomalus | 1.81 |
| VSK-512 | Dipodascus ingens | 2.00 |
| VSK-513 | Candida santamariae | 0.42 |
| VSK-514 | Filobasidium capsuligenum | 1.06 |
| VSK-515 | Dipodascus ingens | 2.50 |
| VSK-516 | Filobasidium capsuligenum | 0.58 |
| VSK-517 | Candida anatomiae | 0.64 |
| VSK-518 | Lindnera fabianii | 1.15 |
| VSK-519 | Pichia mexicana | 0.46 |
| VSK-520 | Sporopachydermia cereana | 2.10 |
| VSK-521 | Sporopachydermia cereana | 0.33 |
| VSK-522 | Candida sonorensis | 1.54 |
| VSK-523 | Pichia cactophila | 1.47 |
| VSK-524 | Pichia cactophila | 1.25 |
| VSK-525 | Saccharomyces pastorianus | 2.63 |
| VSK-526 | Saccharomyces cerevisiae | 1.72 |
| VSK-527 | Saccharomyces cerevisiae | 2.50 |
| VSK-528 | Saccharomyces cerevisiae | 2.25 |
| VSK-529 | Saccharomyces cerevisiae | 2.75 |
| VSK-530 | Saccharomyces cerevisiae | 2.71 |
| VSK-531 | Saccharomyces cerevisiae | 1.54 |
| VSK-532 | Saccharomyces cerevisiae | 2.79 |
| VSK-533 | Saccharomyces cerevisiae | 3.07 |
| VSK-534 | Saccharomyces cerevisiae | 2.38 |
| VSK-535 | Saccharomyces cerevisiae | 2.22 |
| VSK-536 | Saccharomyces cerevisiae | 2.47 |
| VSK-537 | Saccharomyces cerevisiae | 3.08 |
| VSK-538 | Saccharomyces cerevisiae | 2.35 |
| VSK-539 | Saccharomyces cerevisiae | 2.82 |
| VSK-540 | Saccharomyces cerevisiae | 2.83 |
| VSK-541 | Saccharomyces cerevisiae | 2.88 |
| VSK-542 | Saccharomyces cerevisiae | 2.50 |
| VSK-543 | Saccharomyces cerevisiae | 2.44 |
| VSK-544 | Saccharomyces cerevisiae | 2.63 |
| VSK-545 | Saccharomyces cerevisiae | 3.04 |
| VSK-546 | Saccharomyces cerevisiae | 2.83 |
| VSK-547 | Saccharomyces cerevisiae | 2.44 |
| VSK-548 | Saccharomyces cerevisiae | 2.44 |
| VSK-549 | Saccharomyces cerevisiae | 2.79 |
| VSK-550 | Saccharomyces cerevisiae | 2.93 |
| VSK-551 | Saccharomyces cerevisiae | 3.15 |
| VSK-552 | Saccharomyces cerevisiae | 2.83 |
| VSK-553 | Saccharomyces cerevisiae | 2.85 |
| VSK-554 | Saccharomyces cerevisiae | 3.19 |
| VSK-555 | Saccharomyces cerevisiae | 2.96 |
| VSK-556 | Saccharomyces cerevisiae | 2.92 |
| VSK-557 | Saccharomyces cerevisiae | 2.56 |
| VSK-558 | Saccharomyces cerevisiae | 2.21 |
| VSK-559 | Saccharomyces cerevisiae | 2.24 |
| VSK-560 | Saccharomyces cerevisiae | 2.96 |
| VSK-561 | Saccharomyces cerevisiae | 3.33 |
| VSK-562 | Saccharomyces cerevisiae | 2.97 |
| VSK-563 | Saccharomyces cerevisiae | 3.22 |
| VSK-564 | Saccharomyces cerevisiae | 3.32 |
| VSK-565 | Saccharomyces cerevisiae | 3.35 |
| VSK-566 | Saccharomyces cerevisiae | 3.36 |
| VSK-567 | Saccharomyces cerevisiae | 3.18 |
| VSK-568 | Saccharomyces cerevisiae | 3.29 |
| VSK-569 | Saccharomyces cerevisiae | 3.22 |
| VSK-570 | Saccharomyces cerevisiae | 2.81 |
| VSK-571 | Saccharomyces cerevisiae | 3.75 |
| VSK-572 | Saccharomyces cerevisiae | 3.07 |
| VSK-573 | Saccharomyces cerevisiae | 3.36 |
| VSK-574 | Saccharomyces cerevisiae | 3.22 |
| VSK-575 | Saccharomyces cerevisiae | 3.07 |
| VSK-576 | Saccharomyces cerevisiae | 2.93 |
| VSK-577 | Saccharomyces cerevisiae | 3.60 |
| VSK-578 | Saccharomyces cerevisiae | 3.60 |
| VSK-579 | Saccharomyces cerevisiae | 3.00 |
| VSK-580 | Saccharomyces cerevisiae | 2.99 |
| VSK-581 | Saccharomyces cerevisiae | 3.50 |
| VSK-582 | Saccharomyces cerevisiae | 3.58 |
| VSK-583 | Saccharomyces cerevisiae | 3.11 |
| VSK-584 | Saccharomyces cerevisiae | 3.75 |
| VSK-585 | Saccharomyces cerevisiae | 3.43 |
| VSK-586 | Saccharomyces cerevisiae | 2.93 |
| VSK-587 | Saccharomyces cerevisiae | 3.08 |
| VSK-588 | Saccharomyces cerevisiae | 3.60 |
| VSK-589 | Saccharomyces cerevisiae | 3.79 |
| VSK-590 | Saccharomyces cerevisiae | 2.96 |
| VSK-591 | Saccharomyces cerevisiae | 3.18 |
| VSK-592 | Saccharomyces cerevisiae | 3.47 |
| VSK-593 | Saccharomyces cerevisiae | 3.07 |
| VSK-594 | Saccharomyces cerevisiae | 3.33 |
| VSK-595 | Saccharomyces cerevisiae | 3.79 |
| VSK-596 | Saccharomyces cerevisiae | 3.51 |
| VSK-597 | Saccharomyces cerevisiae | 3.32 |
| VSK-598 | Saccharomyces cerevisiae | 3.53 |
| VSK-599 | Saccharomyces cerevisiae | 2.46 |
| VSK-600 | Saccharomyces cerevisiae | 3.49 |
| VSK-601 | Saccharomyces cerevisiae | 3.36 |
| VSK-602 | Saccharomyces cerevisiae | 3.51 |
| VSK-603 | Saccharomyces cerevisiae | 3.64 |
| VSK-604 | Saccharomyces cerevisiae | 3.50 |
| VSK-605 | Saccharomyces cerevisiae | 1.50 |
| VSK-606 | Saccharomyces cerevisiae | 3.92 |
| VSK-607 | Saccharomyces cerevisiae | 3.28 |
| VSK-608 | Saccharomyces cerevisiae | 3.32 |
| VSK-609 | Saccharomyces cerevisiae | 3.38 |
| VSK-610 | Saccharomyces cerevisiae | 3.39 |
| VSK-611 | Saccharomyces cerevisiae | 3.56 |
| VSK-612 | Saccharomyces cerevisiae | 3.24 |
| VSK-613 | Saccharomyces cerevisiae | 3.21 |
| VSK-614 | Saccharomyces cerevisiae | 3.32 |
| VSK-615 | Saccharomyces cerevisiae | 3.40 |
| VSK-616 | Saccharomyces cerevisiae | 3.24 |
| VSK-617 | Kluyveromyces marxianus | 1.46 |
| VSK-618 | Kluyveromyces marxianus | 2.89 |
| VSK-619 | Kluyveromyces marxianus | 1.13 |
| VSK-620 | Kluyveromyces marxianus | 1.33 |
| VSK-621 | Kluyveromyces marxianus | 1.46 |
| VSK-622 | Kluyveromyces marxianus | 1.46 |
| VSK-623 | Kluyveromyces marxianus | 0.92 |
| VSK-624 | Kluyveromyces marxianus | 0.96 |
| VSK-625 | Kluyveromyces marxianus | 1.39 |
| VSK-626 | Kluyveromyces marxianus | 0.92 |
| VSK-627 | Kluyveromyces marxianus | 1.71 |
| VSK-628 | Kluyveromyces marxianus | 2.17 |
| VSK-629 | Kluyveromyces marxianus | 2.40 |
| VSK-630 | Kluyveromyces marxianus | 1.36 |
| VSK-631 | Kluyveromyces marxianus | 1.40 |
| VSK-632 | Kluyveromyces marxianus | 1.61 |
| VSK-633 | Kluyveromyces marxianus | 0.75 |
| VSK-634 | Kluyveromyces marxianus | 0.83 |
| VSK-635 | Pichia fermentans | 1.33 |
| VSK-636 | Pichia fermentans | 1.92 |
| VSK-637 | Pichia fermentans | 1.81 |
| VSK-638 | Pichia fermentans | 2.24 |
| VSK-639 | Pichia fermentans | 0.96 |
| VSK-640 | Pichia fermentans | 1.72 |
| VSK-641 | Pichia fermentans | 0.33 |
| VSK-642 | Debaryomyces hansenii | 0.46 |
| VSK-643 | Debaryomyces hansenii | 0.54 |
| VSK-644 | Debaryomyces hansenii | 0.08 |
| VSK-645 | Debaryomyces hansenii | 2.83 |
| VSK-646 | Debaryomyces hansenii | 1.46 |
| VSK-647 | Debaryomyces hansenii | 1.74 |
| VSK-648 | Debaryomyces hansenii | 0.33 |
| VSK-649 | Debaryomyces hansenii | 0.50 |
| VSK-650 | Debaryomyces hansenii | 0.38 |
| VSK-651 | Debaryomyces hansenii | 0.71 |

TABLE 12-continued

Yeast strain tolerance to 3-HP

| Yeast Strain | Yeast Species | Average Score |
|---|---|---|
| VSK-652 | Debaryomyces hansenii | 0.83 |
| VSK-653 | Debaryomyces hansenii | 1.04 |
| VSK-654 | Debaryomyces hansenii | 0.33 |
| VSK-655 | Debaryomyces hansenii | 0.42 |
| VSK-656 | Saccharomyces pastorianus | 1.25 |
| VSK-657 | Saccharomyces pastorianus | 1.04 |
| VSK-658 | Saccharomyces pastorianus | 2.51 |
| VSK-659 | Saccharomyces pastorianus | 2.54 |
| VSK-660 | Trichosporon pullulans | 2.60 |
| VSK-661 | Candida sake | 0.63 |
| VSK-662 | Candida sake | 1.17 |
| VSK-663 | Cryptococcus tephrensis | 0.63 |
| VSK-664 | Cryptococcus tephrensis | 0.50 |
| VSK-665 | Trichosporon brassicae | 0.38 |
| VSK-666 | Candida sp. | 2.46 |
| VSK-667 | Yarrowia lipolytica | 2.74 |
| VSK-668 | Candida zeylanoides | 2.08 |
| VSK-669 | Torulopsis sp. | 1.07 |
| VSK-670 | Meyerozyma guilliermondii | 2.17 |
| VSK-671 | Wickerhamomyces anomalus | 1.38 |
| VSK-672 | Yarrowia lipolytica | 2.94 |
| VSK-673 | Candida boidinii | 1.17 |
| VSK-674 | Pichia membranifaciens | 1.63 |
| VSK-675 | Pichia membranifaciens | 2.88 |
| VSK-676 | Candida sp. | 2.36 |
| VSK-677 | Magnusiomyces ingens | 0.75 |
| VSK-678 | Trichosporon dulcitum | 0.83 |
| VSK-679 | Scheffersomyces stipitis | 0.71 |
| VSK-680 | Yarrowia lipolytica | 2.99 |
| VSK-681 | Hanseniaspora uvarum | 1.83 |
| VSK-682 | Hanseniaspora sp. | 2.63 |
| VSK-683 | Priceomyces carsonii | 0.67 |
| VSK-684 | Trichomonascus ciferrii | 1.29 |
| VSK-685 | Trichosporon veenhuisii | 0.42 |
| VSK-686 | Sugiyamaella smithiae | 0.38 |
| VSK-687 | Trichosporon aquatile | 0.71 |
| VSK-688 | Schwanniomyces polymorphus | 2.82 |
| VSK-689 | Priceomyces haplophilus | 1.92 |
| VSK-690 | Debaryomyces robertsiae | 2.38 |
| VSK-691 | Candida rhagii | 0.71 |
| VSK-692 | Metschnikowia reukaufii | 0.88 |
| VSK-693 | Metschnikowia agaves | 0.88 |
| VSK-694 | Komagataella pastoris | 0.33 |
| VSK-695 | Lodderomyces elongisporus | 1.04 |
| VSK-696 | Saccharomyces eubayanus | 1.63 |
| VSK-697 | Candida parapsilosis | 2.04 |
| VSK-698 | Torulaspora delbrueckii | 3.14 |
| VSK-699 | Torulaspora delbrueckii | 1.29 |
| VSK-700 | Hanseniaspora uvarum | 2.00 |
| VSK-701 | Hanseniaspora osmophila | 2.54 |
| VSK-702 | Zygosaccharomyces rouxii | 0.92 |
| VSK-703 | Cryptococcus flavescens | 1.13 |
| VSK-704 | Torulaspora delbrueckii | 2.36 |
| VSK-705 | Wickerhamomyces anomalus | 2.22 |
| VSK-706 | Rhodosporidium toruloides | 0.75 |
| VSK-707 | Candida sp. | 0.71 |
| VSK-708 | Pichia jadinii | 1.13 |
| VSK-709 | Pichia jadinii | 1.17 |
| VSK-710 | Candida humilis | 3.60 |
| VSK-711 | Pichia membranifaciens | 3.04 |
| VSK-712 | Rhodosporidium toruloides | 1.79 |
| VSK-713 | Candida zeylanoides | 2.64 |
| VSK-714 | Candida diddensiae | 0.46 |
| VSK-715 | Pichia membranifaciens | 1.67 |
| VSK-716 | Saccharomyces cerevisiae | 1.92 |
| VSK-717 | Candida mesenterica | 2.13 |
| VSK-718 | Saccharomyces cerevisiae | 2.79 |

Example 2: Bioinformatic Genome Mining for Pathway Enzyme Candidates

Homology-based database searches were conducted to identify candidate enzymes for a particular functionality. In each case, the databases were searched with a number of query sequences. Additionally, members of the relevant protein family were retrieved from Uniprot/SwissProt based on the InterPro domain annotations. The homology-based searches were conducted against Uniprot (SwissProt and TrEMBL) and GenBank protein databases (nr, pat and env_nr) using blastp, and against GenBank nucleotide databases (tsa_nt, env_nt and pat) using tblastn. Sequences with an E-value smaller than 1e-30 were extracted; however, in some cases, additional analysis was conducted on sequences with an E-value smaller than 1e-80. Nucleotide hits were translated to protein sequences with GeneWise using the query sequence as a guide in the translation. The task of translating the long ACC sequences was too difficult for GeneWise, so instead the protein sequence (portion matching to the query sequence) was extracted from the blast-xml output. To remove redundant sequences, the retrieved sequences were clustered, using BLASTCLUST or CD-HIT, to clusters containing sequences above 80% identical to each other. Only one representative sequence was kept from each cluster. The non-redundant set of sequences was aligned, either to the PFAM domain of the protein family or by using MAFFT. Global alignment by MAFFT was created in cases where the protein family was not associated with any PFAM or if the protein's sequence was split to several PFAM domains. A phylogenetic tree was created based on the multiple sequence alignment using PHYLIP or FASTTREE. The tree was annotated with E.C. numbers, organism name, blast E-values, and visualized using the Geneious software.

2-1: Acetylating Acetaldehyde Dehydrogenase

The reduction of acetaldehyde to acetyl-CoA can be accomplished by an acetylating acetaldehyde dehydrogenase (AADH, E.C. 1.2.1.10). AADHs can be divided into three groups of functional homologues (Wei et al., *Nat. Commun.* 4:2580, 2013), including 1) bifunctional proteins having AADH and alcohol dehydrogenase activities (*E. coli* adhE type genes, GenBank No: NP_415757, query sequence), 2) proteins involved in ethanolamine catabolism (*E. coli* eutE type genes, GenBank No: AAG57564, query sequence) and 3) bifunctional proteins that are part of an aldolase-dehydrogenase complex involved in 4-hydroxy-2-ketovalerate catabolism (*E. coli* mphF type genes, GenBank No: NP_414885). Of particular interest are the group 1 (adhE type) and group 2 (eutE type) enzymes.

The N-terminal domain of the AdhE protein is highly homologous to aldehyde:NAD+ oxidoreductases, whereas the C-terminal region is homologous to a family of Fe2+-dependent ethanol:NAD+ oxidoreductases (Membrillo-Hernandez et al., *J. Biol. Chem.* 275:33869-33875, 2000). Acetylating acetaldehyde dehydrogenase activity can also be introduced to the cell by truncating the bifunctional AdhE protein to only possess the N-terminal aldehyde reductase domain by removing the alcohol dehydrogenase domain. Additional genes having this bifunctional AADH activity were inferred based on bioinformatic analyses and sequence homology. The various genes are summarized in Table 1.

Many enterobacteria can utilize ethanolamine as a carbon and nitrogen source (Stojiljkovic et al., *J. Bacteriol.* 177:1357-1366, 1995). This catabolic pathway involves a step where acetaldehyde is converted by acetylating acetaldehyde dehydrogenase, EutE, to acetyl-CoA. Novel genes having this AADH activity were inferred based on bioinformatic analyses and sequence homology. The various genes are summarized in Table 2.

In addition, based on bioinformatic analyses and sequence homology to the adhE and eutE type genes, there is a group of genes annotated as aldehyde dehydrogenases which can be inferred to have AADH activity. The various genes are summarized in Table 3.

2-2: Eukaryotic Acetyl-CoA Carboxylase

Acetyl-CoA carboxylase (ACC, EC 6.4.1.2) is a multi-functional biotin-dependent carboxylase that is a key enzyme of fatty acid biosynthesis. It uses the cofactors ATP and biotin to catalyse the conversion of acetyl-CoA to malonyl-CoA. The reaction proceeds in two steps. First, the biotin carboxylase catalyses the ATP-dependent carboxylation of biotin with bicarbonate. Second, the carboxyl transferase transfers the carboxyl group from biotin to acetyl-CoA to form malonyl-CoA. Eukaryotic enzymes are large multidomain enzymes whereas corresponding prokaryotic enzymes consist of multiple subunits encoded by distinct genes.

The activity of ACC is controlled at the transcriptional level and also at the post-transcriptional level (e.g. by phosphorylation and aggregation) in order to sustain acetyl-CoA homeostasis. ACC engineering in different yeast species has resulted in increased ACC activity and increased production of malonyl-CoA derived products. Genes encoding for enzymes having ACC activity have been demonstrated or postulated in *Saccharomyces cerevisiae* (GenBank No: CAA96294.1, query sequence), *Yarrowia lipolytica* (GenBank No: XP_501721.1, query sequence) and *Mucor circinelloides* (GenBank No: EPB82652.1, query sequence). Candidate acetyl-CoA carboxylase genes were identified in the newly sequenced genomes of *Kazachstania exigua* (SEQ ID NO: 1) and *Candida humilis* (SEQ ID NO: 2) and cloned into our yeast expression plasmid. Additional genes having ACC activity were inferred based on bioinformatic analyses and sequence homology. The various eukaryotic multidomain ACC genes are summarized in Table 4.

2-3: Bifunctional Malonyl-CoA Reductase

The reduction of malonyl-CoA to 3-HP (via a malonate semialdehyde intermediate) can be accomplished by a large bifunctional malonyl-CoA reductase which possesses both functionalities of C-terminal aldehyde dehydrogenase domain and N-terminal alcohol dehydrogenase domain. A highly substrate-specific and NADPH-dependent enzyme with this activity was characterized in the phototrophic green nonsulfur bacterium *Chloroflexus aurantiacus* (GenBank No: AAS20429.1; query sequence) which participates in an autotrophic $CO_2$ fixation pathway termed the 3-hydroxypropionate cycle (Hugler et al., *J. Bacteriol.* 184:2404-2410, 2002). Additional genes having this bifunctional malonyl-CoA reductase activity were inferred based on bioinformatic analyses and sequence homology. The various genes are summarized in Table 5.

2-4: Malonyl-CoA Reductase

In contrast to the bifunctional malonyl-CoA reductases discussed above, malonyl-CoA can also be catalyzed to 3-HP by two separate enzymes. By this route, malonyl-CoA is first reduced to malonate semialdehyde by malonyl-CoA reductase (MCR; EC 1.2.1.75) or a CoA-acylating malonate semialdehyde dehydrogenase and then subsequently reduced to 3-HP by a 3-hydroxypropionate dehydrogenase (3-HPDH; EC 1.1.1.59 or EC 1.1.1.298). MCR is an NADPH-dependent enzyme used by some thermoacidophilic archaea to autotrophically fix carbon into organic material via a 3-hydroxypropionate/4-hydroxybutyrate cycle (Berg et al., *Science*, 318:1782-1786, 2007). Genes encoding for enzymes having this MCR activity are characterized in *Metallosphaera sedula* (GenBank No: ABP94884.1, query sequence) and *Sulfolobus tokodaii* (GenBank No: BAB67276.1, query sequence). Although these MCRs share a similar aldehyde dehydrogenase activity to the *Chloroflexus aurantiacus* bifunctional malonyl-CoA reductase enzymes, they do not exhibit any significant sequence similarity suggesting that the autotrophic pathways in *Chloroflexus* and Sulfolobaceae evolved convergently and that different genes were recruited to execute similar metabolic processes in these taxonomic groups (Alber et al., *J. Bacteriol.* 188:8551-8559, 2006). In particular, the archaeal MCRs show high sequence similarity to aspartate-semialdehyde dehydrogenases. Additional genes having this MCR activity were inferred based on bioinformatic analyses and sequence homology. The various genes are summarized in Table 6.

2-5: 3-Hydroxypropionate Dehydrogenase

Malonate semialdehyde can be reduced to 3-HP by a reversible 3-hydroxypropionate dehydrogenase (HPDH; EC 1.1.1.59, NADH-dependent) or a malonate semialdehyde reductase (EC 1.1.1.298, NADPH-dependent). These enzymes naturally participate in beta-alanine metabolism, propanoate metabolism or uracil degradation in bacteria and plants. In addition, these enzymes are required by some thermoacidophilic archaea for fixing carbon via the 3-hydroxypropionate/4-hydroxybutyrate cycle (Kockelkorn and Fuchs, *J. Bacteriol.* 191:6352-6362, 2009). Genes encoding for enzymes having 3-hydroxypropionate dehydrogenase or malonate semialdehyde reductase activity have been demonstrated or postulated in *Escherichia coli* (GenBank No: EFV00080.1, query sequence), *Saccharomyces cerevisiae* (GenBank No: DAA10125.1, query sequence), *Metallosphaera sedula* (GenBank No: ABP96133.1, query sequence), *Sulfolobus tokodaii* (GenBank No: BAK54608.1, query sequence) and *Escherichia coli* (GenBank No: ACR64730.1, query sequence). Additional genes having 3-hydroxypropionate dehydrogenase or malonate semialdehyde reductase activity were inferred based on bioinformatic analyses and sequence homology. The various genes are summarized in Table 7.

2-6: 3-Hydroxyisobutyrate Dehydrogenase

3-Hydroxyisobutyrate dehydrogenase (HIBADH; EC 1.1.1.31) is a key enzyme involved in the metabolism of valine and the other branched-chain amino acids. HIBADH catalyzes the NADH- or NADPH-dependent reversible conversion of 3-hydroxyisobutyrate to methylmalonate semialdehyde. However, as a result of its wide substrate specificity, HIBADH has also been shown to exhibit 3-hydroxypropionate dehydrogenase activity (i.e. EC 1.1.1.59) by converting malonate semialdehyde to 3-HP (Yao et al., *Appl. Biochem. Biotechnol.* 160:694-703, 2010). Enzymes with HIBADH activity have been identified in *Pseudomonas putida* (GenBank No: ADR61938.1, query sequence), *Pseudomonas aeruginosa* (GenBank No: AAG06957.1, query sequence), *Bacillus cereus* (GenBank No: AAP10961.1, query sequence) and *Alcaligenes faecalis* (GenBank No: EJC65559.1, query sequence). Additional genes having this HIBADH activity were inferred based on bioinformatic analyses and sequence homology. The various genes are summarized in Table 8.

2-7: 4-Hydroxybutyrate Dehydrogenase

4-Hydroxybutyrate dehydrogenase (HBDH; EC 1.1.1.61) is an enzyme naturally involved in butanoate metabolism. HBDH catalyzes the reversible NAD+-dependent conversion of 4-hydroxybutanoate to succinate semialdehyde. However, HBDH can also convert malonate semialdehyde to 3-HP as the enzymatic reaction is similar. Enzymes with HBDH activity have been identified in *Cupriavidus necator* (GenBank No: AAC41425.1, query sequence) and *Clostridium kluyveri* (GenBank No: EDK35022.1, query sequence). Additional genes having this HBDH activity were inferred based on bioinformatic analyses and sequence homology. The various genes are summarized in Table 9.

2-8: 3-Hydroxybutyrate Dehydrogenase

3-Hydroxybutyrate dehydrogenase (BDH; EC 1.1.1.30) is an enzyme that is naturally involved in butanoate metabolism. BDH catalyzes the reversible NAD+-dependent conversion of 3-hydroxybutyrate to acetoacetate but it can also oxidize other 3-hydroxymonocarboxylic acids. For example, BDH can convert malonate semialdehyde to 3-HP as the enzymatic reaction is similar. An enzyme with BDH activity has been identified in Pseudomonas aeruginosa (GenBank No: GAA17557.1, query sequence). Additional genes having this BDH activity were inferred based on bioinformatic analyses and sequence homology. The various genes are summarized in Table 10.

Example 3: Measurement of Enzyme Activities

ACC Spectrophotometric Enzyme Assays

Spectrophotometric ACC assays are coupled assays where a product produced by the ACC reaction is further consumed in a reaction which requires the cofactor NAD(P)H whose oxidation can be monitored with a spectrophotometer.

Kroeger et al. (2011, Anal. Biochem. 411:100-105) described a coupled assay where malonyl-CoA produced by ACC1 is converted further to malonate semialdehyde by purified malonyl-CoA reductase (MCR) in a reaction that requires NADPH as a cofactor. ACC activity was measured by following NADPH oxidation.

Diacovich et al. (2002, J. Biol. Chem. 277:31228-31236) combined the conversion of ADP, a hydrolysis product of ATP which is used as a cofactor in the ACC reaction, to an ADP-requiring pyruvate kinase reaction which was further coupled to the formation of pyruvate using lactate dehydrogenase. The latter enzyme requires NADH as a cofactor whose oxidation was followed.

ACC Radioactive Enzyme Assays

The most commonly used in vitro ACC assay is based on the usage of radioactive $^{14}C$ carbonate. The incorporation of radioactive carbonate into an acid and a non-volatile material (i.e. malonyl-CoA) is followed. The $^{14}C$-labelled sodium bicarbonate which has not been converted to malonyl-CoA is removed by an acid and heat treatment which converts the remaining $NaH_{14}CO_3$ and the possible side products of the reaction into $^{14}C$-labelled $CO_2$.

This assay described by Diacovich et al. (2002, J. Biol. Chem. 277:31228-31236) has been used to detect ACC activity from yeast lysates (Shi et al. 2014, mBIO 5:3 e01130-14) with slight modifications. The cell lysates were prepared from yeast cells harvested during late exponential or stationary phase. The cells were washed and then resuspended in lysis buffer containing 100 mM potassium phosphate pH 7.5, 2 mM $MgCl_2$, 1 mM dithiothreitol and 1×EDTA free Complete protease inhibitor (Roche). The cells were disrupted by glass beads and the supernatant was collected after centrifugation at 4° C.

The ACC enzyme assay reaction mixture included 100 mM potassium phosphate (pH 8.0), 300 µg of BSA, 3 mM ATP, 5 mM $MgCl_2$, 10 mM $NaH_{14}CO_3$ [specific activity 200 µCi $mmol^{-1}$ (7400 kBq mmol)] and 0.5 mM acetyl-CoA. Total volume of the reaction was 100 µL which included 20 µL of cell extract.

The reaction was incubated at 30° C. for 15 min, and stopped by adding 50 µL of 5 M HCl. The contents of the tubes were evaporated to dryness at 95° C. and the residue was resuspended in 100 µL of water and mixed with 3 mL of scintillation cocktail (Ultima Gold AB, PerkinElmer). The $^{14}C$ content of the samples was determined using a liquid scintillation counter (PerkinElmer Tri-Carb 2810TR).

AADH Enzyme Assay

AADH activity was measured as described by Kozak et al. (2014, Metab. Eng. 21:46-59) by monitoring the reduction of $NAD^+$ at 340 nm at 30° C. The yeast cells for the cell lysates were collected, washed with water, and then resuspended into lysis buffer containing 100 mM Tris-HCl buffer (pH 7.5) and 1×EDTA free protease inhibitor cocktail (Roche). The cells were lysed with glass beads in a Precellys 24 homogenizer at 5500 rpm for 3×40 seconds and kept on ice between rounds. Lysates were centrifuged at 16 000 g for 20 min at 4° C. and supernatants were collected. The total protein concentration was determined using the Bradford method.

The enzyme assay reaction mixture contained 0.1 mM Coenzyme A, 50 mM CHES buffer (pH 9.5), 0.8 mM $NAD^+$, 0.2 mM DTT and 10 µL of cell extract in a total reaction volume of 200 µL. The reaction was started by adding 10 mM of freshly prepared acetaldehyde solution and reduction of $NAD^+$ was followed with a Thermo Konelab 20XT analyser.

MCR Enzyme Assay from Yeast Cell Lysates

The MCR enzyme activity was measured according to the method described by Chen et al. (2014, Metab. Eng. 22:104-109) with slight modifications. The method is based on monitoring the oxidation of NAD(P)H at 340 nm.

Cells were collected and washed with cold wash buffer containing 20 mM Tris-HCl (pH 7.5), 20 mM $NaN_3$ and then resuspended in 1 mL of breaking buffer containing 50 mM HEPES (pH 7.5), 150 mM KCl, 1 mM DTT, 1 mM EDTA, 0.5% Triton X-100 and 1×EDTA free protease inhibitor cocktail (Roche). The cells were lysed with glass beads in a Precellys 24 homogenizer at 5500 rpm for 3×40 seconds and kept on ice between rounds. Lysates were centrifuged at 16 000 g for 20 min at 4° C. and supernatants were collected. The total protein concentration was determined using the Bradford method.

The MCR assay mixture contained 50 mM Tris-HCl buffer (pH 8.0), 5 mM $MgCl_2$ and 0.3 mM NADPH or NADH. After adding 20 µL of cell lysate into a total reaction volume of 200 µL, the reaction was pre-incubated for five minutes at 30° C. after which the reaction was started by addition of 0.15 mM malonyl-CoA. The assay was monitored at 340 nm with a Thermo Konelab 20XT analyser.

Generation of Yeast Expression Vectors

A series of yeast expression plasmids were generated in order to evaluate the candidate genes for their expression and activity capabilities in yeast. First, a new pBlueScript-based multiple cloning site (MCS) was designed so that all possible restriction enzyme (RE) site combinations could be utilized. This modified MCS was then placed into the pRS-based series of yeast centromeric and multicopy plasmids. Afterwards, using a set of 10 unique RE sites, nine different sets of promoters and terminators were cloned into these pRS-based yeast expression vectors. Thus, this plasmid system could be utilized to constitutively express up to 9 genes simultaneously at either a low or high copy number in a suitable yeast strain in order to evaluate a variety of pathway enzyme combinations for the production of 3-HP.

Cloning of the ACC Genes

ACC1 genes which have been transformed into the industrial S. cerevisiae VSK-128 strain with and without a SNF1 deletion are presented in Table 13. ACC genes were expressed from a multicopy plasmid where they were under control of the PDC1 promoter. Mutated ACC1sc genes described in a publication by Shi et al. (2014) were constructed with a QuikChange II Site Directed Mutagenesis Kit (Agilent Technologies).

TABLE 13

Acetyl-CoA carboxylase genes transformed to *S. cerevisiae* VSK- 128.

| | |
|---|---|
| ACC1sc | *S. cerevisiae* wild-type ACC1 |
| ACC1sc$^{S659A}$ | *S. cerevisiae* S659A mutant ACC1 |
| ACC1sc$^{S1157A}$ | *S. cerevisiae* S1157A mutant ACC1 |
| ACC1sc$^{S659A/S1157A}$ | *S. cerevisiae* S659A/S1157A mutant ACC1 |
| ACC1ch | *C. humilis* wild-type ACC |
| ACC1ke | *K. exigua* wild-type ACC |
| ACC1mc | *M. circinelloides* wild-type ACC |
| ACC1yl | *Y. lipolytica* wild-type ACC |

ACC Enzyme Assays

In the literature spectrophotometric assays have been used to detect ACC enzyme activity with purified or partially purified ACC enzymes. Spectrophotometric assays were tested with yeast cell lysates where ACC had been overexpressed but no absorbance change was detected compared to the controls.

The radioactive ACC enzyme assay is very sensitive, even pmol/mg/min activities can be detected. The method was first tested with purified human ACC enzyme which is commercially available. As clear activity was detected the method was further optimised to detect ACC activity from yeast cell lysates. The strains listed in the Table 13 were assayed for their ACC1 activity and based on the results; a list describing the relative ranking of the ACC s was made (FIG. 2). The most promising candidate, ACCyl was studied more and the results of the *S. cerevisiae* S-128 wild-type strain and the same strain where ACC1 has been overexpressed are presented in Table 14.

TABLE 14

Overexpression of the ACCyl gene resulted in a 2.9-fold increase in the ACC1 enzyme activity compared to the endogenous ACC1 activity of the wild-type *S. cerevisiae* VSK-128 strain.

| | Mean ACC1 activity (pmol min$^{-1}$ mg total protein$^{-1}$) | Std. Dev. | # of replicates |
|---|---|---|---|
| *S. cerevisiae* VSK-128 wild-type | 25.55 | 0.74 | 2 |
| *S. cerevisiae* VSK-128 (ACC1yl) | 73.79 | 17.23 | 4 |

AADH In Vitro Enzyme Activity Assays

Five AADH genes were originally chosen (i.e. ADHEpm, ADHEec, EUTec, EUTdz and LIN1129li) and transformed into the CEN.PK lab strain. These AADHs were expressed from a multicopy plasmid where they were under control of the TEF1 promoter. All five AADH genes showed AADH activity, but the three eutE-type AADH genes (i.e. EUTec, EUTdz and LIN1129li) gave much higher AADH activity in yeast compared to the adhE-type AADHs (i.e. ADHEpm and ADHEec).

Twenty additional novel AADH genes were chosen from the genome mining analyses to be evaluated for expression and enzyme activity in yeast. These twenty novel AADH genes were tested for in vitro enzyme activity and four of them (i.e. AADHmm, AADHab, AADHbw and AADHvs) were shown to have AADH activity.

AADH In Vivo Growth Assays

All copies of the ACS2 gene were deleted from the industrial *S. cerevisiae* VSK-128 strain in order to generate a strain with a defective PDH-bypass that was incapable of growth on glucose-based medium. Expression vectors carrying the 25 different AADH variants were then transformed into this ACS2 deletion strain to evaluate their ability to recover the growth of this strain on glucose.

Twelve different AADH variants (i.e. EUTEec, EUTEdz, LIN1129li, AADHmm, AADHtl, AADHab, AADHta, AADHbs, AADHbw, AADHvs, AADHhs and ADHEec) were capable of recovering the growth deficiency of the ACS2-deletion strain based on their capability to grow on glucose-based agar plates. There was a good correlation between the in vitro AADH enzyme activity assays and the in vivo growth recovery analyses.

The growth rate of the first nine AADH variant strains which were found to be capable of recovering growth of the ACS2 deletion strain were then evaluated in liquid shake flask cultivations and compared to the wild-type strain containing the intact PDH-bypass. All nine of these AADH variants were able to maintain >50% of the *S. cerevisiae* VSK-128 strain's aerobic growth rate when grown on glucose and six of these AADH variants were able to maintain ≥80% of the *S. cerevisiae* VSK-128 strain's aerobic growth rate.

MCR Enzyme Assays in Yeasts

The eight full-length *Chloroflexus* MCR homologues were truncated into their two functional domains and the MCR-specific domains were assayed for enzyme activity in yeast along with the six archaeal MCRs. These MCRs were expressed from a multicopy plasmid where they were under control of the TEF1 promoter and transformed into the CEN.PK lab strain.

MCRca (*Chloroflexus aurantiacus*) and its homologue MCRrc (*Roseiflexus castenholzii*) were the only two *Chloroflexus* MCR homologues that gave MCR enzyme activities higher than the wild-type strain when utilizing NADPH as a cofactor. No enzyme activity was observed from these eight *Chloroflexus* MCR homologues when utilizing NADH as a cofactor.

Three of the archaeal MCRs [*Sulfolobales archaeon*, *Sulfolobus acidocaldarius* (×2)], gave MCR enzyme activities higher than the wild-type strain when utilizing NADPH as a cofactor and all six of the archaeal MCRs gave MCR enzyme activities higher than the wild-type strain when utilizing NADH as a cofactor.

Heterologous Expression and Characterization of Archaeal MCRs pBAT T7 promoter based expression constructs were made for four different archaeal MCRs, *Metallosphaera sedula* (MCRms), *Sulfolobus tokodai* (MCRst), *Candidatus caldiarchaeum* (MCRcc), and *Sulfolobales archaeon* (MCRsa1). These constructs do not contain a purification tag and were *E. coli* codon optimized and expressed under the conditions described earlier in this report (Table 15).

TABLE 15

Overview of the archeal MCRs constructs for expression in *E. coli*.
(ca—*Chloroflexus aurantiacus*, ms—*Metallosphaera sedula*,
st—*Sulfolobus tokodaii*, cc—*Candidatus caldiarchaeum*,
sa1—*Sulfolobales archaeon*, sa2—*Sulfolobales acidocaldarius*)

| MCR Variant | Position of the StrepII tag | Length of the MCR gene (bp) | Calculated MW of the MCR (kDa) |
|---|---|---|---|
| MCRca (*E. coli* codon optimized) | N-terminal | 2037 bp | 74.5 |
| MCRms (Yeast codon optimized) | C-terminal | 1098 bp | 40.4 |
| MCRst (Yeast codon optimized) | C-terminal | 1095 bp | 40.3 |
| MCRms (*E. coli* codon optimized) | N-terminal | 1098 bp | 40.4 |
| MCRsa1 (*E. coli* codon optimized) | N-terminal | | |
| MCRst (*E. coli* codon optimized) | N-terminal | | |
| MCRcc (*E. coli* codon optimized) | N-terminal | | |
| MCRms (*E. coli* codon optimized) | No tag | 1098 bp | 40.4 |
| MCRsa1 (*E. coli* codon optimized) | No tag | 1074 bp | 40 |
| MCRst (*E. coli* codon optimized) | No tag | 1095 bp | 40.3 |
| MCRcc (*E. coli* codon optimized) | No tag | 1053 bp | 40 |
| MCRsa2 (*E. coli* codon optimized) | No tag | 1065 bp | 39.2 |

Their activity was analyzed using the following assay conditions: 0.4 mM NAD(P)H; 0.15 mM Malonyl-CoA; Tris-HCl pH 7; 2 mM $MgCl_2$. Assays on 20 times diluted lysates were performed in microtitre plate (MTP) format at RT. The oxidation of NADPHT or NADHT at $A^{365}$ in time was followed. Among the four archaeal genes tested, MCRsa1 and MCRst showed the highest MCR activity. However, the MCR activities were smaller than that measured for the tagged MCRca. No activity on NADPH or NADH could be measured (in the *E. coli* cell lysate) for the *Candidatus caldiarchaeum* MCR (MCRcc).

When analysing these constructs using SDS-PAGE gels, MCRsa1 showed the highest expression levels in the *E. coli* lysate, while MCRcc could not be expressed in a soluble form; see the gel (sal>ca>st>ms>cc) (FIG. 3). Constructs MCRsa1 and MCRst seem to have dual cofactor preference and showed about 40-50% relative NADH activity when compared to that measured on NADPH. In terms of specific activity, MCRst may be the most active enzyme of the four archaeal MCRs tested, since it showed a relative high activity level at a relatively low expression level.

Example 4: Production of 3-HP by Culturing a Recombinant Yeast

Shake Flask Cultivations for *S. cerevisiae*

A small loop of cells was taken from strains freshly grown on selective agar-based plates and used to inoculate 20 mL of selective SC-based medium (20 g/L of glucose) in a 250 mL flask and grown for 2 days (30° C., 250 rpm) until all glucose and ethanol had been consumed. The final cell density was measured and the cultures were centrifuged for 5 min at 4000 rpm. The supernatants were then analysed by HPLC or GC/MS to determine the accumulation of 3-HP and other major metabolites in the culture supernatants. However, other cultivation conditions were also tested depending on the particular strain and objective (e.g. starting amount of glucose, amount of aeration, type of medium and addition of additional substances to the medium, etc.).

Example 5: Bioreactor Cultivations for *S. cerevisiae*

Cultures were carried out in Multifors bioreactors (maximum working volume 500 mL, 2 4-bladed Rusthon turbine impellors, Infors HT, Switzerland) containing 250-500 mL medium. Cultures were maintained at 30° C., 300 or 900-950 rpm, with 1.2, 2.4 or 3.6 volume gas (volume culture)$^{-1}$ min$^{-1}$ (vvm) initially. Culture pH was kept constant at pH 5.5±0.2 by the addition of sterile 2 M NaOH or 2 M $H_3PO_4$. Clerol FBA 3107 antifoam (Cognis France, Ponthierry Paris; 0.03% v/v) was added to control foam production. Gas concentration ($CO_2$, $O_2$, $N_2$ and Ar) was analysed continuously in a Prima Pro Process mass spectrometer (Thermo Scientific, UK) calibrated with 3% $CO_2$ in Ar, 5% $CO_2$ with 0.99% Ar and 15% $O_2$ in $N_2$, 20% $O_2$ plus 20% Ar in $N_2$, and 0.04% ethanol in $N_2$.

Strains were pre-grown overnight in shaken flasks in SCD-based selective medium and used to inoculate the bioreactors. The batch phase of the cultures (20 g/L initial glucose) was allowed to continue for 14 to 20 h and the glucose feed was started only after glucose had been consumed, but either after or before ethanol had been consumed (depending on the cultivation objective). The glucose feed rate was maintained at 0.38-0.65 g L$^{-1}$ h$^{-1}$ (depending on the cultivation objective). Supernatant samples were then analysed by HPLC to determine the accumulation of 3-HP and other major metabolites in the cultures.

Example 6: 3-HP Analysis from Cell Culture Supernatants by HPLC

The culture supernatant samples were analysed with Waters Alliance e2695 HPLC system (Waters, Milford, USA) where the injection volume was 10 μl. An Aminex HPX-87H Organic Acid Column (300 mm×7.8 mm) (Bio-Rad, USA) linked to a Fast Acid Analysis Column (100 mm×7.8 mm) (Bio-Rad, USA) was used as a stationary phase in the HPLC. Columns were maintained at +55° C. and 5.0 mM $H_2SO_4$ (Merck KgaA, Germany) was used as an eluent with the flow rate of 0.3 or 0.5 ml min$^{-1}$. Waters 2489 dual wavelength UV (210 nm) detector (Waters, Milford, USA) and Waters 2414 differential refractometer (Waters, Milford, USA) were used for the detection of 3-hydroxypropionic acid, glucose, acetate, succinate, pyruvate, glycerol and ethanol.

Example 7: 3-HP Analysis from Cell Culture Supernatants by GC/MS

The test samples and standard curve were prepared in the following way: Supernatant (0.5 ml) was acidified with 50 μl of HCl (6N) and spiked with 3-HPA (TCI) standard (in ethylacetate). 5 μl of the lactic acid internal standard solution (Sigma Aldrich (ISOTEC) sodium L-lactate-3,3,3-d3 98 atom %; 5.5 g/l) and approximately 0.2 g of NaCl were added. Since labelled 3-HP is not commercially available, this lactic acid stable isotope product was chosen as the internal standard since it was the most structurally/chemically similar compound to 3-HP that was available which is not present in the sample matrix. The mixture was shaken for approximately 3 min in a vortex mixer. The sample was then extracted two times with 0.5 ml of ethyl acetate by mixing for approximately 3 min in a vortex mixer. The layers were separated by centrifuging at 10 000 rpm for 5 min. The upper layers were collected into a GC vial and evaporated. The dried residues were derivatized with MSTFA (50 μl) containing 1% of TMCS by incubating at 60° C. for 1 h. The standards for the calibration curve were extracted in the same way as the samples in order to minimize errors.

The samples were run on an Agilent 6890 gas chromatograph (GC) combined with Agilent 5973 mass selective detector (MSD). The injector (injection volume 1 μl with split ratio 20:1) and MSD interface temperatures were 280°

C., and the oven temperature program was from 50° C. to 280° C. at a rate of 20° C./min. The analyses were performed on an Agilent HP-5MS capillary column (30 m, ID 200 μm, film thickness 0.25 μm; Agilent 19091S-433). The identifications of the compounds were based on a spectral search from the NIST library. 3-HP was detected by monitoring m/z 147 and m/z 219 and 3-HP dimer was detected by monitoring m/z 177. Five point calibration curves (c=1-400 mg/1) were constructed by using the 3-HP responses and an internal standard was used for normalization. The quantification proved to be linear at this concentration range. Blank samples were analysed together with the samples.

Example 8: Evaluation of *S. cerevisiae* Plasmid Expression Strains

The 3-HP plasmid expression strains simultaneously expressed one, two or three 3-HP pathway enzymes (i.e. AADH, ACC1, MCR and HPDH) from two different expression plasmids (i.e. pSK-084 and/or pSK-085) (FIG. 4). These strains were used to evaluate the effects of the different 3-HP pathway enzymes (and combinations of these enzymes) on the production of 3-HP in the VSK-128 acid-tolerant *S. cerevisiae* strain. The strains were cultivated in 20 mL of selective SC-based medium (20 g/L of glucose) in 250 mL flasks and grown for 2 days (30° C., 250 rpm) until all glucose and ethanol had been consumed.

Example 9: Summary of the In Vivo Pathway Enzyme Activity Analyses

Twenty-five AADHs, 8 ACC1s, 10 bifunctional HPDH-MCRs, 6 Archaeal MCRs and 28 HPDHs in Table 16 were analyzed for their ability to produce 3-HP in various *S. cerevisiae* strains which were also expressing additional 3-HP pathway enzymes if needed. Many novel 3-HP pathway enzymes (obtained from the genome mining analyses) were shown to be active in yeast and many of them were shown to possess superior properties (i.e. higher activities, better cofactor preference) when compared to previously published 3-HP pathway enzymes.

TABLE 16

| Type | Gene Abbreviation | SEQ ID NOs. |
|---|---|---|
| Genes encoding AADHs | AADHab | SEQ ID NO: 3 |
| | AADHal | SEQ ID NO: 4 |
| | AADHbs | SEQ ID NO: 5 |
| | AADHbw | SEQ ID NO: 6 |
| | AADHcs | SEQ ID NO: 7 |
| | AADHho | SEQ ID NO: 8 |
| | AADHhs | SEQ ID NO: 9 |
| | AADHma1 | SEQ ID NO: 10 |
| | AADHma2 | SEQ ID NO: 11 |
| | AADHmm | SEQ ID NO: 12 |
| | AADHpa | SEQ ID NO: 13 |
| | AADHpb | SEQ ID NO: 14 |
| | AADHpe | SEQ ID NO: 15 |
| | AADHrw | SEQ ID NO: 16 |
| | AADHsl | SEQ ID NO: 17 |
| | AADHss | SEQ ID NO: 18 |
| | AADHta | SEQ ID NO: 19 |
| | AADHtl | SEQ ID NO: 20 |
| | AADHtm | SEQ ID NO: 21 |
| | AADHvs | SEQ ID NO: 22 |
| | ADHEec | SEQ ID NO: 23 |
| | AHEpm | SEQ ID NO: 24 |
| | EUTEdz | SEQ ID NO: 25 |
| | EUTEec | SEQ ID NO: 26 |
| | LIN1129li | SEQ ID NO: 27 |

TABLE 16-continued

| Type | Gene Abbreviation | SEQ ID NOs. |
|---|---|---|
| Genes encoding ACC1s | ACC1sc_S659A | SEQ ID NO: 28 |
| | ACC1sc_S659A/S1157A | SEQ ID NO: 29 |
| | ACC1sc_S1157A | SEQ ID NO: 30 |
| | ACC1ke | SEQ ID NO: 31 |
| | ACC1mc | SEQ ID NO: 32 |
| | ACC1sc | SEQ ID NO: 33 |
| | ACCyl | SEQ ID NO: 34 |
| | ACC1ch | SEQ ID NO: 35 |
| Genes encoding bifunctional HPDH-MCRs | HPDH-MCRbs | SEQ ID NO: 36 |
| | HPDH-MCRca | SEQ ID NO: 37 |
| | HPDH-MCRcag | SEQ ID NO: 38 |
| | HPDH-MCRct | SEQ ID NO: 39 |
| | HPDH-MCRgb | SEQ ID NO: 40 |
| | HPDH-MCRot | SEQ ID NO: 41 |
| | HPDH-MCRrc | SEQ ID NO: 42 |
| | HPDH-MCRsl | SEQ ID NO: 43 |
| | HPDH-MCRca_variant_3 | SEQ ID NO: 44 |
| | HPDH-MCRca_variant_6 | SEQ ID NO: 45 |
| Genes encoding HPDHs | BDHcm | SEQ ID NO: 46 |
| | BDHkp | SEQ ID NO: 47 |
| | HBDHos | SEQ ID NO: 48 |
| | HBDHps | SEQ ID NO: 49 |
| | HIBADHas | SEQ ID NO: 50 |
| | HIBADHbc | SEQ ID NO: 51 |
| | HIBADHma | SEQ ID NO: 52 |
| | HIBADHpa | SEQ ID NO: 53 |
| | HIBADHxc | SEQ ID NO: 54 |
| | HPDHam | SEQ ID NO: 55 |
| | HPDHbs | SEQ ID NO: 56 |
| | HPDHca | SEQ ID NO: 57 |
| | HPDHcag | SEQ ID NO: 58 |
| | HPDHct | SEQ ID NO: 59 |
| | HPDHec | SEQ ID NO: 60 |
| | HPDHed | SEQ ID NO: 61 |
| | HPDHgb | SEQ ID NO: 62 |
| | HPDHhw | SEQ ID NO: 63 |
| | HPDHka | SEQ ID NO: 64 |
| | HPDHms | SEQ ID NO: 65 |
| | HPDHot | SEQ ID NO: 66 |
| | HPDHps | SEQ ID NO: 67 |
| | HPDHra | SEQ ID NO: 68 |
| | HPDHrc | SEQ ID NO: 69 |
| | HPDHsi | SEQ ID NO: 70 |
| | HPDHsl | SEQ ID NO: 71 |
| | HPDHsm | SEQ ID NO: 72 |
| | HPDHst | SEQ ID NO: 73 |

Example 10: *S. cerevisiae* Shake Flask Cultivation Trials for 3-HP Production

Cultivation Conditions

Various different cultivation conditions were evaluated on a couple early testing strains to see how the various culture conditions affected the strain's ability to produce 3-HP. The *S. cerevisiae* VSK-128 (Δura3, Δhis3) strain expressed two plasmids where one of the plasmids contained either the HIBADHpa or the HPDHec gene and the second plasmid contained the MCRsa2 gene. Both strains behaved similarly during the cultivations and had very similar metabolite profiles.

Six different shake flask cultivation conditions were tested:
1. Aerobic, batch process, high initial glucose (120 g/L). Another 100 g/L of glucose was added on Day 3.
2. Anaerobic, batch process, high initial glucose (100 g/L). The flasks were sealed and the shaking was slower at 100 rpms.
3. Aerobic, batch process, repeated glucose spiking. Initial glucose was 20 g/L, then 40 g/L was added every subsequent day.
4. Aerobic, simulated fed-batch process, many initial glucose tablets. 5 tablets were initially added, another 5 tablets were added on Day 3. Varying amounts of Enzyme A solution (50-150 μl per day) were added each day.

5. Aerobic, simulated fed-batch process, repeated spiking of glucose tablets. 1 tablet was initially added, 2 tablets were added on Days 1 and 2, 3 tablets were added on Days 3 and 4. Varying amounts of an Enzyme A solution (50-150 μl per day) were added each day.
6. Aerobic, batch process, repeated galactose spiking. Initial galactose was 20 g/L, then 40 g/L was added every subsequent day.

For the simulated fed-batch cultivations, each tablet is thought to release 0.5 g of glucose (which equates to 20 g/L of glucose for our 25-mL culture volumes). The tablets essentially consist of glucose (i.e. starch) and an Enzyme A solution (i.e. amylase) allowing for the controlled slow release of glucose into the medium during the shake flask cultivations. It was hypothesized that glucose-limited fed-batch conditions may promote flux towards growth and subsequently to 3-HP production.

Cell Growth

All of the regular glucose based cultivations grew similarly and the galactose fed cultivation grew more slowly. On the other hand, the fed-batch conditions promoted more cell growth compared to the other cultivation conditions. In particular, the fed-batch (tablet spiking) conditions really promoted a lot of growth early in the cultivation.

3-HP Production

For these cultivations, the majority of the growth had generally occurred by the end of Day 2 and the vast majority of 3-HP had also been produced by Day 2, thus indicating that growth and 3-HP production are linked to each other. The fed-batch (tablet spiking) cultivation condition produced the most 3-HP (~0.85 g/L) and the galactose fed cultivations produced the least amount of 3-HP (~0.12 g/L) and the other cultivation conditions all produced about 0.3 to 0.4 g/L of 3-HP. These results demonstrate that cultivation conditions can have a large effect on the 3-HP production levels (FIG. 5).

Glucose Consumption

Glucose was quickly consumed in all of the cultivation trials up until Days 2-3, then the glucose consumption rates decreased significantly (during days 4-5) along with growth and 3-HP production. For the fed-batch cultivations, glucose seems to have been consumed as quickly as it was being released from the tablets, suggesting that these cultivations were performed under glucose-limited conditions.

Glycerol, Acetate and Ethanol Accumulation

Glycerol accumulation was quite high for the glucose fed cultivations and was much lower for the galactose fed cultivations. Acetate accumulation was fairly similar amongst the different cultivation conditions but the fed-batch (many tablets) conditions produced much more acetate.

High amounts of ethanol accumulated for most of these shake flask cultivations, especially for the glucose batch cultivations and the glucose spiking cultivations. The fed-batch cultivations aimed to represent glucose limited conditions to reduce excess overflow metabolism to ethanol and this approach seems to have succeeded since ethanol accumulation was significantly lower in the fed-batch cultivations.

Cultivation of a More Established 3-HP Production Strain

An additional 3-HP production strain [(EutEec, HPDH-MCRca, ACC1sc_S1157A) and (HIBADHpa, MCRsa2)] was cultivated according to the most promising fed-batch (tablet spiking) cultivation conditions to check its performance.

Again, most of the growth had occurred by Day 3 and most of the 3-HP production had occurred by Day 3. 3-HP production exceeded 1.2 g/L with this strain under this cultivation condition, (FIG. 6).

Although specific embodiments of the present invention are described in detail, it will be apparent to those skilled in the art that the specific description is merely desirable exemplary embodiment and should not be construed as limiting the scope of the present invention. Therefore, the substantial scope of the present invention is defined by the accompanying claims and equivalent thereof.

INDUSTRIAL APPLICABILITY

The use of the recombinant yeast and the method for preparing 3-HP of the present invention enables 3-HP production in a high concentration and a high yield at a low pH from a useful sugar such as glucose, thereby greatly contributing to economical production of 3-HP from biomass and its applied products.

SEQUENCE LISTING (275 sequences)

SEQ ID NO: 1 - protein, 2248 aa, Kazachstania exigua
MSEENLFEDSSAKRQYEITDYSKKHKALAPHFVGLNTLDKVEESPLKDFVKSHGGHTVISKILIANNGIAAVKEIRSVRKWSYETFGDERTVQFVAMATPEDLQANSEYIRMADQYVEVPGGTNNNNYANVDLIVDVAERTDVDAVWAGWGHASENPHLPEKLAASKRKIIFIGPPGSAMRSLGDKISSTIVAQHAKVPCIPWSGTGIDKVHVDETSGLVSVDDDVYQQGCCQSPEDGLAKAKQIGFPVMIKASEGGGGKGIRQVEREEDFIALYHQAANEIPGSPIFIMKLAGKARHLEVQLLADQYGTNISLFGRDCSVQRRHQKIIEEAPVTIANNETFDKMANAAVRLGKLVGYVSAGTVEYLYSNEEKKYYFLELNPRLQVEHPTTEMVSGVNLPSAQLQIAMGIPMHRISDIRVLYGMNPHSATEIDFEFKTEEAKKTQRKPVPKGHCTACRITSEDPNEGFKPSGGSLHELNFRSSSNVWGYFSVGNNGGIHSFSDSQFGHIFAFGENRQMSRKHMVVALKELSIRGDFRTTVEYLIKLLETEDFEENTITTGWLDDLISHKMTAEKPDATLAVICGAATKAFIASESARMEYIAQLKRGQVPAKNLLETMFPVEFIHENKRYKFTVAKSADDSYTLFINGSKCEVRAVKLSDGGLLISVGGQSHTIYWKEEAQATRLSIDSMTTLLEVENDPTQLRTPSPGKLVKFLVENGDQIKVGQAYAEIEVMKMQMPLVSQENGVIQLLKQPGSTIAAGDIIAMLALDDPSKVKHALPFEGMLPELGSPMVEGTKPAYKFKSLVSTLENILKGYDNQVIMNASLQQLIEVLRDPRLPYSEWKLCVSALHSRLPMSLDEKLDQLVDRSSNRNAIFPAKQLNKMIEDAVREPGSDELLPTIVEPLLDITNRYANGLEAHEHSVFVKFLEEYYNVEKLFSSHGNREENVILKLRDENLDSLDKVVEIVLSHAKVSAKNTLILAILKHYQPICKMSSSVAHIFSKSLGHIVELESKSAAKVALQAREILIQGALPSVKERTEQIEHILRSSVTNTSYGDLAPKKSEPNLEILKDLIDSNYVVFDVLLPFLCHEDPVIATAAAQVYVRRAYRAYTVGEVKTPNIKDSSISPLIEWKFQLPSAAFSSIPQVKSKIGMNRAMSVSDLSYVVDNEHAPLRTGILVASEHLDDVDACLAQGLEAIPEHANTANGPAPDRSGNSSSLSNVANVCVSSTEGFESEKDILARVHEILDLNKSDLIKSSIRRITFMFGFADGTYPKYYTFNGPNYQENQTIRHIEPACAFQLELGRMSNFNIKPIFTENRNIHVYEAISKTSALDKRFFTRGIIRTGRIRDEISIQEYLTSEANKLMSDILDNLEIVDTSNSDLNHIFINFSAVFDVSPEDVEAAFGGFLERFGKRFLRLRVSAAEIRIIIQDPKTGAAVPLRALINNVSGYVVKSELYTEIKNDKGEWVFKSLGKPGSMHLRPIATPYPVKEWLQPKRYKAHLMGTTYLYDFPELFHQAAITTWEKYLSNSSAKELSSIKDRDDLFISHELIEDENGELTEVEREPGANTIGMVAFKVTMKTPEYPRGRQFVIVANDITFKIGSFGPQEDEFFNKVTEYARKRGIPRIYLAANSGARIGIAEELVPLFQVAWKDSKVPAKGFEYLYLSKEGMETLKSYSKQNSVITERVVEEGEERYVIKSIIGADDGLGVECLRGSGLIAGATSRAYQDIFTITLVTCRSVGIGAYLVRLGQRAIQIEGQPIILTGAPAINKVLGREVYSSNLQLGGTQIMYNNGVSHLTASDDLQAVEQIINWLSYVPAKRNMPVPILETEDKWDRAIDFRPTTNEQYDVRWLIQGRELDNGDFEYGMFDKGSFFETLSGWAKGVVVGRARLGGIPIGVIGVETRTIENVIPADPANPDSTETVVQEAGQVWYPNSAFKTAQAIQDFNHGEQLPLMILANWRGFSGGQRDMYNEVLKYGSFIVDALVDYKQPIFIYIPPTGELRGGSWVVVDPTINNDHMEMYADKDSRAGVLEPSGMVGIKYRREKLLSTITRLDSTYRELKEKLSDKLLSTEEHQKISIQLAEREKMLIPIYNQISVQFADLHDRSSRMLKKGVIKAELTWEESRRYFFWRLRRRLDEEYLLRRLDSQLTQASRLEKIARVRSWYPTSVDVENDKEVVTWIEENYETLEEKFKALKLESFALDLAKNIRNDHENSMKGLEEVVRMLSATDKERLNKIINPDDKK

SEQ ID NO: 2 - protein, 2243 aa, Candida humilis
MSEENLFEDAAAKRQYEITDYSTKHKTLASHFVGLNTLERVEESPLKDFVKSHGGHTVISKILIANNGIAAVKEIRSVRKWAYETFGDERTVQFVAMATPEDLQANSEYIRMADQYVEVPGGTNNNNYANVDLIVDVAERTDVDAVWAGWGHASENPHLPEKLAASKRKIIFIGPPGSAMRSLGDKISSTIVAQHAKVPCIPWSGTGVDTVHLDSETGLVSVDDDIYQKGCCSSPEDGLAKAKKIGFPVMIKASEGGGGKGIRQVEREEDFIALYHQAANEIPGSPIFIMKLAGKARHLEVQLLADQYGTNISLFGRDCSVQRRHQKIIEEAPVTIASNETFEKMASAAVRLGKLVGYVSAGTVEYLYSSEEKKYYFLELNPRLQVEHPTTEMVSGVNLPSAQLQIAMGIPMHRISDIRVLYGMNPHGATEIDFEFKTEEAKKTQRKPVPKGHCTACRITSEDPNEGFKPSGGSLHELNFRSSSNVWGYFSVGNNGGIHSFSDSQFGHIFAFGENRQMSRKHMVVALKELSIRGDFRTTVEYLIKLLETEDFEENTITTGWLDDLISHKMTAQKPDATLAVICGAATKAFIASESARKEYINQLKRGQVPPKGLLETMFPIEFIHENKRYKFTVAKSADDSYTLFINGSKCEVRAVKLSDGGLLISVGGQSHTIYWKEEAQATRLSIDSMTTLLEVENDPTQLRTPSPGKLVKFLVENGDQIKVGQPYAEIEVMKMQMPLVSQENGVIQLLKQPGSTIDAGDIIAMLALDDPSKVKHAMPFEGMLPELGSPMVEGTKPAYKFHSLVSTLENILKGYDNQVIMNASLQQLIEVLRDPRLPYSEWKLNVSALHTRLPLALDEKLDKLVERSANRSAIFPAKQLQKMIDDAVRDPQADPLLSSIVEPLLDITTRYANGLEAHEHSVFVKFLEEYYNVEKLFSEHGERAENVILKLRDENIDDLDKVVLIVLSHAKVSAKNTLILAILKHYQPICKMSSSVAHIFTKPLQHIVELESKPAAKVALQAREILIQGALPSVKERTEQIEHILRSSVTNTSYGDSSPKVSEPNMEILKDLIDSNYVVFDVLLPFLCHEDPVIATAAGQVYVRRAYRAYTVGEVKSHSITDSSMNPLIEWKFQLPSAAFSSIPQLKSKIGMNRAMSVSDLSYVVDSEHAPLRTGILVAAEHLDEVDASLAQGLEVIPEHSAPGNGPAPDRSGSSSSLSNIVNVCVASTEGFDSEKEILARVNEILELNKADLIKSSIRRITFMFGFPDGTYPKYYTFNGPNYQENQTIRHIEPACAFQLELGRMSNFNITPIFTDNRNIHVYEAVSKTSALDKRFFTRGIIRTGRIRDEISIQEYLTSEANKLMSDILDNLEIIDTSNSDLNHIFINFSAVFDVSPEDVEAAFGGFLERFGKRFLRLRVSAAEIRIIIQDPKTGAPVPLRALINNVSGYVVKSELYTEIKNAKGEWVFKSLGKPGSMHLRPIATPYPVKEWLQPKRYKAHLMGTTYVYDFPELFHQAAITTWQKYKTNSSQKDLTTMKERDDLFISHELIEDESGELTEVEREPGANSIGMVAFKVTMKTPEYPRGRQFVIVANDITYKIGSFGPQEDEFFNKVTEYARKRGIPRIYLAANSGARIGIAEELVPLYQVAWKDADVPAKGFEYIYLNKDEMETLKGHSKENSVITERIVEDGEERFVIKAIIGADDGLGVECLRGSGLIAGATSRAYQDIFTITLVTCRSVGIGAYLVRLGQRAIQIEGQPIILTGAPAINKVLGREVYSSNLQLGGTQIMYNNGVSHLTASDDLQAVEQIIKWLSYVPAKRNMPVPILENGDKWDRQIDYRPTVNEQYDVRWMIEGRELEDGRFEYGMFDKGSFFETLSGWAKGVVVGRARLGGIPIGVIGVETRTIENVIPADPANPDSTEAVVQEAGQVWYPNSAFKTAQAIKDFNHGEQLPLMILANWRGFSGGQRDMYNEVLKYGSFIVDSLVDYKQPIFIYIPPTGELRGGSWVVVDPTINADQMEMYADKDSRAGVLEPSGMVGIKYRREKLLATMTRLDTTYRELKEQLSDKTLTPAQHQEVSVKLAEREKFLLPIYTQVSVQFADLHDRSSRMVKKGVIRAELTWEESRRFFFWRLRRKLDEEYLVKRLDIELPHASRLEKLARLRSWYPASIDETKDRDVVTWIEENYNVFEEEFKALKLESFAQELAKSMRTDHDVTMRGLEEIARMLSKEDKERLLSALK

SEQ ID NO: 3 - DNA, 1443 bp, Artificial Sequence
  AADHab
atggaaattaacgaaaaagatttgaagttgattattgaaaacgtattggacaagttagaaagtgacaagagtgataaaaagatattcgattcttcattgaatattccatccagtggtcaagacggtatatttgaagaagtcaacgctgcagtagatgccgctgaagcagcccatttggaattaatgaaattgacattagaaaagagaagagaaataatcagatctataagaaagatcataatgtctaatttggaagaaatctcaaagttagctgtcgaagaaactacattcggtagagtagaagataagatcgaaaagaacagattggctgcattaaaaacaccaggtattgaagatttggaacctaccgcatactcagatgacaacggtatgactttgatggaaagagccgcttacggtgttataggttccataatcccaagtactaaccctacatcttcagttatcaataacggtatttccatgatagctggtggtaatagtgttgtctttaacccacatcctgcagccaaaagatccagttgtttcacaatctccttgattaatcaagcaatagttaaggccggtggtccacctaatgtcttgtgcgccattgctaacccaactatagattctgcacaaacattgatgaagcacccaaaaattaagttgttagtagttaccggtggtcctgcagtcgtaaagactgctatgaactctgataaaaaggttattgctgcaggtccaggtaacccaccttgtgttgtcgatgaaactgctgacttagttaaagcaggtagagatattgtcaatggtgctggttttgacaataacatagtttgtatctgcgaaaaggaaatattggccgtttctcaaatcgctgatcaattgaaggaagaaatgattaagaatggtgcccatgaattgaagggtgaacaaatcgaaaaggttacaaagttagtcattaccgatccaggtaaacctggtcacgaaggtgcaccaaataagaaatacgtcggtaaaaatgcttctgtaattgcaagagatataggtttagacatctcagaacaaacaaagatattgttgtgtgaagtagatagataccatcctttggtttggaccgaacaattgttaccagtaattccattggttagattcaataacgttgatgaagccatagactttgctgttcaatgtgaacataatttcagacactctgcttcaatccactctaaaaacattgcaacattgtcaagaatggccaagttgatgaactgctccttattcattaagaatggtccaaactacagtggtttaggttttggtggtgctggttacacctcattcactatagcaacccctactggtgaaggtttgactagagctagaacttttactagagaaagaagatgtgtattagttggttacttcagaattgtttga

SEQ ID NO: 4 - DNA, 1434 bp, Artificial Sequence
  AADHal
atggtagatcaaaccttaatagaacaaataacaagagccgtattgacccaaatgaaagctggtaaagacgccgccgtatccggtgacggtatttttgccacagttgatcaagctgtcgctgcagccagacaagcttatcaagaattgagattgttaaccttggaaaagagagaaactttgataagagctatcagagatgctgcattcgcaaatgccgctgtaattgcccaaatggctgttcaagaatccggtatgggtagagttgaagataagatcttgaagaaccaattagcagccagaaaaaccccaggtactgaagatttgacttctagagcttggtcaggagatcatggtttgacattagtagaaatggccccttacggtgttattggtgctataacaccaactacaaatccttctgaaaccgttatttgtaactcaatcggtatgattgctgcaggtaattccatagtttttagtccacaccctactgctcaaaatacatccttgaccactatcagattgttaaacgaagctattgtcaaagcaggtggtccagataatttgttaacagccgttgctgaacctagtatcgaagccgctaacgcaatgatgagacatccaggtattcaaatgttggttgctactggtggtcctgccgttgtcaaggctgtcttatcttcaggtaaaaaggcaattggtgcaggtgccggtaatccacctgccgtagttgatgaaactgcagacatagccaaagcagccaaggatatcgttgcaggttgttcattcgacaataacttgccatgcattgctgaaaaggaaattatagcagttggtagaatagccgatgaattgatctcctatttgcaaaagtacggtgcatacttaataagtggtagagacatagaaagattgatggaagtcgtattaacagaaagaaccgaagaaatggctccaggttgtgttggtaaacctagaagagtctacggtgtaaataaggattacattggtaaagacgccaagtttatattgtctaaaatcaacatacaagctccagatcatataagagttatcttatgcgaaacaccagctgaccaccctttcgtcttggaagaattaatgatgccagtattgcctttagtttcagtcagagatattgacgctgcaatagatttggcagtaaaagttgaacatggtaatagacacaccgctgtcatgcattctaagaacgtagactatatgactagattagctaaggcaatcgaaacaaccatattcgtaaagaatgcaccatcatacgccggtataggtgttggtggtgaaggttttactacttttactattgctggtcctactggtgaaggtttgacatccgcaagaagttttactagacaaagaagatgcgctttagttgatgcattctctattgtctga

SEQ ID NO: 5 - DNA, 1395 bp, Artificial Sequence
  AADHbs
atggatgaaataatgataaagaacatagtaagagaagtattgatgaaaactaatttggatatctcctgtaagagtgaccaaggtgtatttgaagatgttaatgacgcaattgatgctgcatatattgcccaaagagactggtatatgaactacaaggtcgaagatagaagaagaatcatcgaagctatcagagttgtcgctagagaaaatgcaccaatgttcgccaagatgattcatgaagaaaccggtatgggtagatacgaagataagatcactaagaacttggcagttatagataaaactccaggtgttgaatgtttggtcacagacgccatctctggtgactcaggtttaatgattgaagaacaagctccttttggtgttattggtgcaataactccatctacaaaccctacagaaaccatcattaataacacaatctcaatgataggtggtggtaatgcagtagttttcaacgttcatccaggtgctaaaaaggtctgtgcagtatgcttgcaaatcttgcacaagactatcgttgaaaacggtggtccagctaacttaataacaatgcaaagaaagcctgatatggaagccgttaataagttgacagcttcccctaagattagattaatggttggtaccggtggtatgggtatggttaacgcattgttgaagtctggtaaaaagacaattggtgctggtgcaggtaacccacctgtcgtagttgatgacaccgctgatttggacaaagccgcttccgaaatatatagaggtgccagtttcgataacaacttgttgtgtttggctgaaaaggaaactttcgtaatggacaatgttgctgatgaattgattagaaagatgtgtgcctgcggtgctcatttgataaccccacaagaaactgaacaattgttgaaagttattttcttggaaaaggacggtaaatactctgttaacaaaaagtgggtcggtaaagatgcttctttgatcttagaatcaataggtatcaaggatgcagacacaagattggtcttatgcgaagtaccacatgatcacccttttgttttggtcgaacaattaatgccaataatgcctatcgtcagatgtaaaactttcgaagattgcgtaaagtatgcagtcgtagccgaaaatggtaacagacataccgcctccatgttcagtaaaaatgttgatcacatgactagattcgctaaggaaatcgaaactacaatattcacaaagaacgcagccaccttggtaggcgttggtataggtggtgaaggtcacaccactatgactatcgcaggtcctacaggtgaaggtttaacctgtgccagatcttttactagaagaagaagatgtatgttggctgatggtggtttaagagttatttga

SEQ ID NO: 6 - DNA, 1455 bp, Artificial Sequence
  AADHbw
atggacgtcagacaacaagatgtagaaagaatcgtagtagaagtattgaaaaagatgatgagtgatcaaccaaccgctgctgccacaacagttgtcgctgcatccggttgtgattgcggtgactttggtttgttcgatagattggaagatgctgtccaagccgctgaagcagcccaaaagaaaattagtacagtagcaatgagagataagattatagctgcaataagaaaggctggtttggaaaatgccaaagcttttgcagaaattgcacataacgaaaccggtatgggtagagtctctgataagatcgctaagaatatcttggtatgcgaaagaactcctggtacagaatgcttatccccaatggcaattagtggtgacatgggtttgactttaatagaaaatgcaccttggggtgtaatcgcctctgttaccccttcaactaacccaaccgctactgttataaataacgccatctccatgattgctggtggtaatagtgttatctttgctccacatcctaacgctaagagagcatctcaaactgcaatccaagtattgaataaggctatcatagaagcaacaggtgttgccaacttgttagtcgctgtaaaagaacctaccattgaagttgcacaagaattattctcacacccaagaattaaattgttagtagttactggtggtgaagccgtcgtagcccaagctagaaaagttgctacaatgagattgattgccgctggtgcaggtaatccacctgttgtcgtagatgaaacagccaacattgctagagcagccagatctatatatgatggtgcctcattcgacaataacatcatctgtgctgacgaaaaggaaattatagcagttgattctattgccgaccaattaaaagctgaaatgaaggcaattggtgccgttgaaatatcattggaacaagcagatgccgtcgctagagttgtcttaagaaattaccctcaagttgaaggtggtaaagctccaaatcctaacccaaaatgggtcggtagagatgctgcattgatagcaaaggccgctggtattgatgttccagactcctgcagattgttaatcgttgatgtcaagagagacataaaccatgtctttgctagagtagaacaattgatgcctgtaattccattgttgagagcagccaacgttgatgaagctatcgaatgggcattgattttagaaagaggtttgtctcataccgctggtatgcactcaagaaatattgataacatggacaagatggcaagagccatgaacacttcattattcgttaaaaacggtcctcacttggctgcattaggtgctggtggtgaaggttggactacaatgacaatttccacaccaaccggtgaaggtgttacctgtgctagaagttttgtcagattaagaagatgttgcgtagttgataacttcagaatagtttga

SEQ ID NO: 7 - DNA, 1314 bp, Artificial Sequence
  AADHcs
atgaagtcctccatatactccagtgtttccgaagctgtaatggctgctagaggtgcttttaatagatacgccgatttgaccttgaatgaaagaaaagaaattatagaagctgtcaaggctgcagtaagaccaagaattacacaattggcagaaatgaccgccgctgaaactggtatgggtaacgttgcagataagatcgaaaagatcagattggccgtcgaaaagactccaggtgtagaagatttgattacagaagtaaacaccggagatcatggtatgactttgtatgaattatcagcatttggtgttgtctgtgccgttcacccatgtactaatccttgcgctacattgatttccaacaccatcggtattttagcagccggtaatgctgtagttcattgtccacaccctagagcagttagagtctctcaatacttaactggtatgatatctgatgctgttagagatgtttgcggtattgataacttggtcgtaactgttggtgaatccttaatgggtagtacaagagaaatcatgtcacatccagatgttgacttgattgtctgcactggtggttccggtcctttaagacaagccatgagtgctggtaaaaaggtcattggtgcaggtccagccaatcctgtagctatagttgatgaaacagcagacttggaaagagctgcaagagatattgttaaaggtgcttctttcgacaataacttaatgtgtacctccgaaaaatctattgtagccgttgaaaagatagctgatgaattgatctctcatttggaaagaaacggtgtttactacactagatcagcagaagaaatagatagattgtattgcaccgccgtaactgaagatttcgttatcaacaaaaagatggaaggtcaatctgctgatgttattttggacgccgctaagatcccacatagaaagggtattaagttgatcgtcgccgaaacagatagaacccaccctttcgctacattggaattgttgatgccattgttgcctttagttagagccagagattttgacgaagctttggaagcagccttagatatcgaacaaggtttcagacataccgctactattcactctgaatcagttgaaagaatgaatagagctgctaagaaattgcaaactgcagtctttgttaaaaatggtccatccttgttaggtattggttttgataaggaaggtcatacttcttttactatcggtacaattaccggtgaaggtactacatctgctagacactttgctagaagaagaagatgtactttaacatctggtttctcaattagatga

SEQ ID NO: 8 - DNA, 1458 bp, Artificial Sequence
  AADHho
atggcattgagagaagatagaatagcagaaatagtagaaagagttttagcaagattggatggtaacagtggttcctccgccgcacctcattctggttcaggtgctccagctgcaaccgcaggtggtgcctctttggatattcctagaggtactttaggtgtttatgctgatgcagacgccgctgtcaatgcagccagaagaggttttgctgcaaacgaagctttgccattaagaactagacaagcaatgatagatgccatgagaaaagttgctagagcacatatccctgaattggctagatatgcagttgccgaaacaggtttaggtagatacgaagataaattggcaaagaatgaattagttattgccaagacaccaggtcctgaaatattggctccagttgcatataccggtgacgatggtttgaccttaactgaaagagcaccatacggtgttataggtgcaatcactccatgtacaaatcctacagaaaccgttatttgcaacgcaataggcatgttgtccggtggtaatgccgttgtttttaatgttcatccaagtgccgctagagtctgtaattggttggtacacttgttaaacgaagcaattatgtccgtcggtggtccaagagatgctatcacctccgtagaaagtcctactattgacagtgcccaaaccttgatgactcatgctggtgttagattagtagttgtcactggtggtccaggtgtagttagagcagccatgaaatctggtaaaaaggttatcgctgcaggtcctggtaatccacctgctgtcgtagacgaaactgccaacttggctaaagccgctgcagccattataaagggtgcatcaatagataacaacatcatttgcacagctgaaaaagaaatagtagctgttgcttctattgctgacgaattaagtagattgttaggtcaaagaggtgctttggtattaggtgacgctcaagttagagcattggaaagagttgtcttagacggtgaacatgttaataaggaatgggtcggtaaagatgcctctagaatcgctgaacaaattggtttgagaggtcacggttcagatttgagattgttagtatgtccagttgacgaaggtcatccttttgtacaacacgaattgttaatgccagttattggtttagtcagagtatccgatgctactgaagctatggctacagcagttagagtcgaacatggtttttgccacacagctgttatgcattctacccacattgacagattgtcagctatggctagagtttgtaacgcatcaatattcgttaaaaatgattgcaacttagctggtttgggtttaggtggtgaaggttttacatctttcaccattgcatcaccaacaggtgaaggtttgactacagctagagatttcactagagttagaagatgtacattgaaggaatcttttagattcgtctga

SEQ ID NO: 9 - DNA, 1404 bp, Artificial Sequence
  AADHhs
atgaaaatcaaagaaaacgaattggataaaatagtcaaccaagtaatcagttccttaaacaacaagcaaaacagtaacgacttcaacactaagatcaattacggtattttctctacaatggatgaagcaattgccgaagctgttaaagcacaagcctgtttgcaattaaattactccactgaagctagagaaaagattattaaatctattagaaagaatgtttctaagcatgttgaaaagatttctgaaatggcagttgaagaaacagatatgggtagaatcgaagataagatcattaagaataacttggctattaataagactccaggtacagaagatttgagaaccgaagcctttagtggtaaaaagggtttgactattgtcgaagaagctcctttcggtgtaatctgttctattgcaccagttactaatcctaccgaaactataatctctaacgccatatcaatgatcgcttcctgcaatggtgttgtctttaacagtcacccaggtgctaaaaaggtttctaagtacataatcgaagtcttgaataaggttattatggaagccggtggtccagaaaatttgttaaccgctgtcaacgaacctaccttgcaaactgtagaatcttgtatgagagatgacagaattgcaatgatagttgccacaggtggtccaggtgtagttaatgctgcattatcttcaggtaaaaaggctattggtgctggtgcaggtaacccacctgtcttggtagatgacacagttgatttgaagagagttgccaaagacatcattaatggtgcttcattcgataacaacttaccttgcacttccgaaaaggccattgttgctttggaaagtatagctgattctttgttaaacgaaatgacaaaccaaaacgcacaattagttcatgacatcaaagccttggaaagagtcattttgaacgatgacggtagtataaacaaggcattggttggtaaagatgccgctttcattttgaataaggctggtttaaaggcaaagtctgaagatttgagattagttattgtcgatgtagacttaagacacccatttgtccaaaaggaacaattgatgccagttattcctttagtcagagctaaaaatttcaacgaagcaatggaaatgggtgttgatattgaagaaggtaatagacatacagctatcatccactcaaagaatgtagataacttgaccaagttcgctaagaaaattgaaactacaatctatgttaaaaacgccccatcctacgctggtattggtgcaggtggtgaaggttacgcaacattcaccatagccggtcctacaggtgaaggtttaacctccgctagaagttttactagaaaaagaagatgcgttttggtcgatggtttctcaattatatga

SEQ ID NO: 10 - DNA, 1398 bp, Artificial Sequence
  AADHma1
atgcaaaccgatgctcaacaaatagaaagtatagttagaagagtcatagaacaattacattccccacaaagagatggtgaaagttacggtgtctttagaaccttggatgacgcagtagccggtgctcaaggtgcttacaaaaagataagaactatggctcaaagagaagcaattatagctgcaatcagaagaactggtagtgaaaatgttcaagcattgtctgaattagccgtccaagaaacaggtttcggtagagtagaagataagatcagaaagcatagattggttttagacaaaactcctggtatcgaagctattgttccaatggcagtcacaggagatcatggtttgtctttaattgaaaatgctccttggggtgtaatagcatccgttacccctagtactaacccatctgctactatcttgaacaacgcaatatcaatgatcgccgctggtaattcagttgtcttttccccacatcctgcagccagagctgtctcccaaagaacaatccaattgataaatagagcctctgtttcagctggtggtcctgcaaacttagtcacctgtgtagaagaaccaacaattgaagctgcaaccagattgttttcattccctggtatacaattgttaaccatcactggtggtgaaggtgtagttaatgccgctagaaaagttactgataagagattaatcgcagccggtccaggtaacccacctgtcgtagttgatgaaacagctgacattgaaagagctgcaatttcaatagttcaaggtgcatccttcgataacaacatcatatgtgttgacgaaaaggaaataatcgccgtcgaatccattgctactgaattgaaaactgctatgtgcagacatggtgctgctgaaattaatgcagatcaagcagacgccgtcgctagattggtattagctggttacccaggtcctaacccacaccctaaaccagaatgggttggtagagatgctgaaaagattgcagccgctgcaggttttagtgtacctgcaggtactagattgttagttacagaaaccgaaagagatcatgcattcgccactacagaaatgatgttgccagttatctctttgataagagctagagatgcagaccaagccattgattgggcagttgaattggaagccggtaatagacatacagccgctatgcactcaagaaatatcgacaacttgtccagaatgggtttagaaattaattgttctttgttcgttaaaaacggtccttgcttggccggtttaggtgctggtggtgaaggttggacaagtatgaccatatctactccaacaggtgaaggtgtaaccaacgctagtactttcgttagaaagagaagatgcacaatggttgattctttcagaattgtctga

SEQ ID NO: 11 - DNA, 1422 bp, Artificial Sequence
  AADHma2
atggcctttaatgaagatttgattgcctccatagtagaacaagttttgaaggaaatacaagatgatgaccacgttatcgcctccgctagacaatccgttgtcaaagcaaatgataactggggtgtctatactgatgtagacgaagctatggaagtagttaataaggcacaaaaggaatttgctgcaatgccaatatccaagagagatgaaattataagtgctatcagaacagcaggtgttgaaaacgctgaacatttggcaagaattgcccacgaagttaccggttatggtagaatcgaagataagactgttaagaatagaaacgccgctatgttaactccaggtatagaagatttgcaaaaggaatttttgtctggtgacggtggttcagtcattgtagaatacggtcctatgggtgttatagcttccttgatgccaagtacccatcctactgcatttgttataaatcacgctatcgcaatgttagcagccggtaacgcaatattcatctgtccacatcctaaagcccaagctgcaacattggaagctatgaaggcattgaataaggccattgttgaagctggtggtccaaaatacttgatggttgcagtcgataaggccgacatggaaacctccaacaaagtttatgcacatccttacgttaagatggtcgccgctgcaggtggtgaaggtgttatcagagccgctttaaaaagtggtaaaaaggctattaccggtggtccaggtaatccacctgtcgtagttgatgaaactgctgatattgctaaagcagccaaggatatcattgacggtgaatcttacgataacaacgttttgtgcatagcagaaaaggaagtctttgtcgtagaatcagttgttgatagattgattgctgaaatgcaaaagaataacgcttacttgatcaagggtcaagatgtagctaatttgacaggtgttaccattaaagacggtaaaccaaatggtcaattggtcggtaaaaacccttctgtaattttgaaggaaataggtatcgaagttggtgacgatgttagaactgttatatttgaagctccacctgaacatccattggtaatgatcgaacaattgatgccagttttgcctatagtaagagttaaggatttcgacgaagccgttaaatgggcagtcaaggccgaacatggtgacggtcacacagctatattgcattctaacaacatcaacagaattacagaatatgccagagctatgcaagtcaccgtattagtagttaacgcaccatcttattcatgtatggacccacaatcaaaaactttggtttacgctcacactttaacaggtccaacaggtgaaggtttttgcactcctagacatttcacaagacaagaaagaattgtcttaggtggtgcttttcacttcgtttga

SEQ ID NO: 12 - DNA, 1437 bp, Artificial Sequence
  AADHmm
atggaccaaaaggaaattgaaaacgtagtaaaagccgtcttagcctctatgagtgcaggtacacaaccagcagccgcaagtgccgcaccacaacaagctgcagcctcccaaaataacggttttggtgtattcgaaagtttggatgacgctgttttagctgcaaaagaagcacaaaaatccttgaaaactgttgaaatgagaaatttgtgtatcggtgctatcagaagagccgctaccgaacatgcaagagaattggctgttttagcagtcgaagaaacaggcatgggtagagttgaagataaattggctaaaaatttggcccaagctaacggtactccaggtgtagaatgtttaagaccagaagttttaacaggagatcatggtttgaccttaatagaaaatgcagcctggggtgttattgcttctgtaactccatcaacaaaccctgctgcaacagccatcaataacgctatctctatgattgctggtggtaattcagtcatttttgcaccacaccctgccgctaaaaaggtttctcaaagaacaatcaccatcttgaatgaagctattgttgcagccggtggtccaaataacttgttagtcactgtagccaaacctgatatcgaaacagctcaaagattattcaagtatccaggtataggtttgttagttgtcactggtggtgacgctgtagttgaatccgcaagaaagcatacaaataagagattgattgctgcaggtgctggtaacccacctgtcgtagttgatgaaacagcagacatcgaaagagccgctaaagccattgttcacggtgctagtttcgataacaacatcatctgtgctgacgaaaaagttttgatcgcagtcgattgcattgccgacaagttgatcacagaaatgcaaagaaaccatgcagttttgttgaccagagaacaatctgaaaagttgatccctgtattgttaaagaacgttgatgaaaccggtcacggtactgtctcaagagattgggttggtagagatgctgccaaaatagctgcagccatcggtatgactgttccagcagatacaagattgttaattgccgaaaccgactgtaagcatccttttgctgtcactgaattgatgatgccagtattgcctatcataagagtaaaggatgttgaccaagcaatagatttggccgttaagttagaaggtggttgtcatcacactgctgcaatgcactccaacaacatcagtaatttgaacagaatggcaaacgccattgatacatctatattcgttaaaaacggtccatgcatagctggtttgggtttaggtggtgaaggttggactacaatgaccatcaccactcctactggtgaaggtgttacatgtgcaagaacctttgtcagattaagaagatgcactatggttgattcattcagaattgtctga

SEQ ID NO: 13 - DNA, 1434 bp, Artificial Sequence
  AADHpa
atggaaatacaaaacttagaagaagatatcagaagaattttatcagaagaattgaagaagagtggtacctcacaaaccgcctcaacctctgatgccggtcaaaatggtatattcaagactgtagatgaagctatcgcagcagctaaagctgcagaagatgtttacattgataaaactttagcctttagagaaaaggtcttgactgcaattagagaaggtttcagaccttatatagaaaagatggcaaaagatatcaaagatgaaactggtatgggtacagttgaagcaaaaatcgctaagttgaataacgccttgtacaatacccctggtactgaaattttgcaacctgaagctgaaacaggtgacggtggtttggttatgtatgaatatgctccttttggtgttatcggtgcagttggtcctagtacaaatcctagtgaaacagttatcgccaacgctattatgatgttggccggtggtaatacattatattttggtgcacacccaggtgccaagaaaatcactagatggaccatagaaaaattgaacgaattggtttatgaagctaccggtatgaaaaacttagttgtctccatcgaagaaccatccatcgaatccgttcaagaaatgatgcaacatccagatatcgctatgttgtcaatcacaggtggtccagcagtcgttcatcaagccttggtttcaggtaaaaaggccgttggtgcaggtgccggtaatccacctgctattgttgatgctacagcaaatgttgctttggcagcccataacattgttgattcagcctcctttgacaataacatattgtgcacagctgaaaaggaagttgtcgttgaaagttccgttaaagacgaattgattaagaaaatgcaagaagaaggtgctttcttggttactaatgcatccgacattgataagttggccgaaatgacaatcggtaaaaatggtgcacctgacagacaatttgtcggtaaagatgcaacctatatattggacaaggcaggtattgcttacactggtacaccaaagttaatcattttggaagcccaaaaagaccatcctttggttactacagaaatgttgatgcctattgttccagtcgtatcctgtcctacatttgaccaagtcttagcaacagccgtagaagttgaacaaggtttgcatcacacagcatcaatccactccgaaaacttgcctaatatcaatagagcagcccacagaatgaatacatctatcttcgtcgttaacggtgccacatacgttggtacaggtgttggtgctaacggtgcacatgctggtgcatctgcattgactatcgccacaccaacaggtgaaggtacagcaaccgctaaaacctttacaagaagaagaagattgaacagtccagaagcctttagtttgagaagttgggaagcctga

SEQ ID NO: 14 - DNA, 1434 bp, Artificial Sequence
  AADHpb
atgcaaactacagaagccactatcagaaacgtcgtccaagaagtattagcacaattagccaagcaatcaaatggttcaaacggtgttccaagagcagaaagaaaagccggtgactggggtgttttcgatgacactgaccaagccattgctgcagccaatgaaggttttagagctttatcttctaagggtatggaagaaagagcaaagatcgtagaaatcgttaagagaatctgtgctgatcaagcagaagaattgggtagattggaatttcaagaaaccaaagtcggtagattggaccataagatcgaaaagttgcaaattattaagaaagtaccaggtacagaatggttgagaaccgaagctatgtccggagatcatggtttgacagttattgaatatgcaccttttggtgtaatcggtacaattaccccagttactcacagtttgcctacattagctggtaatgttataaacatggtcgctgcaggtaatactttggttgtcaacccacatccttctggtaaaaagattgcctgtgaaggtgttagaagattcaatagagctatatacgccgctacaggtttggaaaatgtaataaccatcgtttccaacccaactttagaaagtgctgatagaatttttaaccatagagatgttaagatgttatgcgtaactggtggtccaggtgttgctagagcagctatggcttctagaaagaaagccgtagttgctggtcctggtaatccacctgttttggtcgatgaatccgcttgtttacaaaacgctgcagaaagtatcattgccggtgctggttatgacaacaacttgttgtgcataggtgaaaaggaagtattcgtcgtagaatccgtttttgatagattcatgcaagaaatggacaaggcaggtgccgttagattgaatgcatctcaagtcgatcaattatcaaaagtagcctttacaccacctgaaaacgaaaaggatcattaccacgttaacagagacttggtcggtcaacatccatacgttttagctaaacaaatcggtttgccattacctgaatcaacaccattgttatttggtgaaaccgatgaacacaatcctttcgtcgctgaagaacaaatgatgccatttgtccctatagtaagatgtagaaacgcagaacatggtatggatttgtgcgaaaagtatgaacatggtttcagacacacttctttaatccactcaagaaacgttagaaacatgtctatcatgggtaaaagaatggatactacattgtttatcaagaatggtccatcacctgccggtttgggtttaggtggtgaaggttacttatccttcagtattgcaactccaacaggtgaaggtgttaccactcctttgacctttactagacaaagaagatgtacaatggttgatgacttaagaattgtctga

SEQ ID NO: 15 - DNA, 1359 bp, Artificial Sequence
  AADHpe
atggaaatcaaagaaatggtcgccttagccagaaaagcccaaaaagaatatcaagcaacacataatcaacaatcagtagacaacatatgtagagctgcagccaaagttatatatgaaaacgctgaaatgttggcaagagaagccgttgacgaaactggtatgggtgtttatgaagataaagtctccaagaatagaggtaaatctaagggtgtttggtacaacttgcatgacaaaaagtctgtcggtatattaaacattgatgaaagaaccggtatgatcgaaattgccaaacctatgggtgttgtcggtgctgtcaccccaactacaaatcctatagtaactccaatgtctaacatcatcttcgccttgaaaacttgtaacgctatcatcatctcaccacatcctagatctaaaaagtgctcaaaacacgcagttgatttgatcttagaagccattaagcctttcaacgtcccagagggtatggttcaagtcatagaagaaccttccatcgaaatgacacaacaattaatgggtgcagtagatgtagttgtcgcaaccggtggtatggctatggttaaatctgcttattcttcaggtaaaccatcatacggtgttggtgctggtaacgtacaagttattttcgattctgacatagatttcgaagatgctgcagaaaaagttatatatggtagatcctacgataatggtatcatatgtactggtgaacaatctgttatatataacgaagccgacaaagatgctgtttttgccgctttaagaaagagaggtgcatacatttgcacagaagaagaaggtaaaaagatgagagacttgttgttccaaaatggtggtcctattaacaaagatgtagttggtcaaggtgtccaaaagattgctaagatggcaggtattaatgtaccagaaggttctagagtcataatcgtagaagcaaacggtgtaggtgaagaagatgttatctgtagagaaaagatgtgtccagttatgtgcgctttgtcatacaagcatttcgaagaaggtgttgatatcgcatgtagaaatttggccaacgagggtaatggtcattcctgcgctatacacagtaacaaccaagcacatatcatcttgactggttctaaagctacagtttcaagaattgtcgtaaatgccccttcagctaccactgcaggtggtcacatacaaaacggtttgaatgttacaaacaccttaggttgcggttcctggggtaacaactccatcagtgaaaacttcacatacaagcacttgatgaacattagtagaatagctccattgaaccctgctattaaagttccaaacgatcaagaaatctgggaattatga

SEQ ID NO: 16 - DNA, 1383 bp, Artificial Sequence
  AADHrw
atgaccgttaccgctacattggacgcagatttggcagcattggcagacgttagagcacaagtatccgcaactaagaaggcatttgacgccatcgaaggtgctgatcaacaatggttggacgaaattgttagagctatggctaaagcaggttatgatgcttctgaagaattagccagaatggctgtagacgaaacaggttatggtgtttacgaaaataagattattaaaaatagattcaataccggtttcgttgctgattggatgttggaaagaagagccgtaggtgttttatgggctgacgaagaaaacaaggttactgcagtcggttctccaatgggtgtcatagctgcaatcattccagtaacaaatcctactgccacagttttgtttaaatccttggcaagtgttaaggctggtaacgccgttgtccatgctccacaccctagagccgctagatgttctgcaagagcagccgaaattatggccgaagctgcagtccatgccggtgctccagaaaatttggtttcatgcttaagacaacctacattggatgctaccagagaattaatgagacacggtgacattagattggttttagctactggtggtccagcaatggttgccgctgcatattcttcaggtaaaccaaccatagctgttggtgctggtaatgtccctgcttacgtagattccactgttaaagacttggccgaaaccgctactatgatagttacatccaagagtttcgataacggtaccgcatgtgttgccgaacaaagtgtagttatcgccgctccagttgctgatcaattggtccaagaattaggtagagcaggtgccacctggatgactaaagatcaacaagcagccttgacaagaaccttatttgacgaaagaggtggtttgagagctaatgcagtaggtcaatctgcagttagattagccgaaatgtccggtttcactgtccctgctagtacaaaggtattggctgcagaattagatgaagtcggtgaccatgtattgttatcaagagaaatcttgggtccagtattgactgtttacagagaacctgattaccaagcaggttggagaagatgtagagaaattttggctttaggtggtgaaggtcataccgtcgcagtacacacttccgatccagaagtcgtagctaaatttggtgaattgccagcaggtagaattgttgtcaatactcctgctttatttggtggtatgggttactctacaaacgttgatccttcattccaaattggtactggtacatggtctggttcaatatgctcagacaatgttacaccattgcatttggtcaacataaagagaatcgctcacgaagcaagaccttggagaggtgttttcgattga

SEQ ID NO: 17 - DNA, 2616 bp, Artificial Sequence
  AADHsl
atggctattgaagaacactcattgaacgacaaggaatccaagaaagaaaccttagaagaaaccattgacttattagtaacaaacgctaaaacagcttctgaagagtttactccattggatcaacaacaaatagacgaaatcgttagacaaatggcattggccggtttagatcaacatatgcaattggcaaagatggccgtcgaagaaacaaagagaggtgtatacgaagataagatgattaagaatatatttgctacagaatacatctataactctattaagaaaaataagaccgtaggtgttatttcagaagatccatacgaagaaatcgttcaaattgcagaacctataggtgttattgctggtgtcacccctgtaactaacccaacatctactacaatgttcaagtccttgattagtataaagactaaaaaccctataatctttgccttccatccatccgctcaaaagtgtagtgctgcagccgctaaagttgtcagagatgcagccgttaaggctggtgctcctaaaaattgcattcaatggatagaaactccttcattggaagcaacacaaagattaatgcatcacccaggtgtatctttgattttagctacaggtggttcaggcatggttaaggctgcatattcttcaggtaaacctgcaattggtgtaggtcctggtaatgttccagcctacatagaaaagtctgcagatgttaaacaagccgtcaacgacttgatcttgtccaaaactttcgataacggtatgatctgtgctagtgaacaagcagtcatcgtagaccaacaaatctatgaagctgttaaaaaggaaatgattgataataagtgttacttcttgaacaacgaagaaaagaagaaagttgaaaagttagttattgatgaaagaagatgcgcagtcaacccacaaattgtaggtaaaactgctgcttttattgctggtttggcaggtgttacagtccctgaagataccaaagtaattgttgctgaattgtccagtgttggtccagaatctcctttatcaagagaaaaattgtcaccagtcttagcctgttttagagctaagaccactgaagaaggtttcaaaagatgcgaagaaatgttagcatttggtggtattggtcattctgccgtaatacactcaaacgatcaaaaagttatagacgccttcgctatgagaatgaaggctggtagattgatcgttaatgcaccatcttcattaggtggtatcggtgacatctataaccattttattccttccttgaccttaggttgtggtagttacggtggtaattccgtcagtaccaacgtaggtactgctaatttgatcaacatcaagactttggcaaacagaagaaacaacatgcaatggttcaaggttccacctaaaatctatttcgaaaagaacgctaccaaatacttgtctgttatgccagatataactagagcttttattgtagccgaccctggtatggttaaattcggttatgttgacagagtcattcatttcttgaagcaaagaagagatccagttcactacgaagttttctctgatgttgaaccagacccttcagtagctactgttatgaagggtacagaattgatgagaaaatttgaaccagacgttatcattgctttaggtggtggttctgcaatggatgcagccaagggcatgtggttgttctatgaatcacctgaaacagatttctttggtttgaagcaaaagttcttggacataagaaagagagtctttaaattcccagatttgggtaaaaaggctaaattcgtagcaatccctacaacctccggtaccggtagtgaagttacttctttttcagtcataactgataaggaaaacgacatgaagtacccattggccgactacgctttaactcctaacgttgcaataattgatccagaatttgtcttgacagtacctcaaagagtcttagctgattccggtatggacgtattgactcatgcaattgaagcctacgtttctaacatggctaacgatttcacagacggtttatgtatcaaggcaatccaattggtttttaaatatttgccaagatcttacaaggattcaaccgacagagaagccaaggaaaagatgcacaatgcttccactatcgctggtatggctttttctaatgccttcttgggtattaaccattctttggctcacaaattgggtaatgaatttcatttggcccacggtagatgttgcgctatcttgttgcctcatgttataagattcaacgctcaaaagccaacaaaatttgctgcattccctaagtacaagcactttattgctgatgaaagatacgccgaaatagctcaagttttgggtatcgcaggtaaaactacagaagaatctgttgaaaatttggtccaagctattaagaaattgactcaagaattaaacatgccaatgtccatcgaaaagaacggtgttagtaaagaagctttcgaagccgctgtcgataaattagcagacagagcctttggtgaccaatgcacaccagcaaaccctaagatgccattggtttcagaattaaccgaaatctatagacaagcttttaaaggtatttga

SEQ ID NO: 18 - DNA, 1389 bp, Artificial Sequence
  AADHss
atggcagatgaacaattagtccaaaatgtagtaagagaagtagtagcaagaatgcaaatatccgctccagcaagaggtatgcacggtgttttctctgatatggaagaagcaattgaagctgcaagaactgcccaacaaacagttagattgttaccaatggaccaaagagaaaagattatcggtgccataagaagaaaaactagagaaaacgctgaaatcttggcaagaatggccgtaaatgaaacaggcatgggtaacgttggtgacaaaattttgaagcatttgttagtcgccgataaagtaccaggtaccgaagatatctctactagagctttttcaggtgacagaggtttgactttaattgaaatgggtcctttcggtgtaatcggtgctattaccccatgtactaatccttccgaaacagttttatgcaacaccatcggcatgttggcaggtggtaatacagttgtctttaacccacatcctcaagccataaagactacattattcaccatccaaatggttaatgaagcttcattggaagcaggtggtccagataacatagcttgtacagttgacgcccctacattagctacctctgaaatcatgatgaagtcaccacacatcaagttgttagtcgcaaccggtggtcctggtgtagttactgctgtattatcttcaggtaaaagagcaattggtgccggtgctggtaatccacctgccttggtcgatgaaaccgctgacatcagaaaggccgctgaagatatagttaacggttgtactttcgacaacaacttaccatgtattgctgaaaaggaaattgtcgcagtagattctattgccgacgaattgttgcattacatgttgactgaacaaggttgttaccaagcttcagaagaagaattggatagattaacaaaggcagttatggacgaaaagggtagattgaatagaaaagctgtcggtagatccgcaagaaagttgttaagtatgatcggtgttgaagtcgatgctaacataagatgcatcactttctttggtccaaaggaacaccctttgataaccactgaattaatgatgccaatcttgggtatcgtaagagttaaggattttgcagaaggtttagaaacagcagcctggttggaacatggtaataagcactccgctcatatccacagtaaaaacgttgatagaatcacagaatacgcaagaagattagacacaaccattaccgttaagaatggtccttcttatgctgcattgggttttggtggtgaatcttactgtactttcacaatagcatcaagaactggtgaaggtttaacatccgccagaagtttcatcaaatccagacattgtgttatgactgatagtttgtgcgtcagatga

SEQ ID NO: 19 - DNA, 1404 bp, Artificial Sequence
  AADHta
atgaataacactgaattagaatccttgataagaaccattttgaccgaacaattaacaccatccgctactgatacccctgcctgcactgcctcttcagtcgctttatttgatgacgtagattctgctatttgtgctgcacatgccgctttcttaagatatcaagaagcaccattgaaaactagatctgccattatagcagccattagagcagaaatagccccttgcttatcagaattggcagaaagagctgcagccgaaactggtatgggtaacacagctgataagatcttgaaaaataaggctgcattggaaaacacaccaggtattgaagatttgaaaactacagctttgaccggtgacgaaggcatggttttgttcgaatactctcctttcggtgttgtcggtgcagtcgccccatcaacaaaccctactgaaacaatcattaataactccatcagtatgttggccgctggtaatgctatctatttttccccacatcctggtgcaaagaacatcagtttgtggttgatccaaaagatggaagaaatcgcttttaaagtttgtggtatccataacttgattgtcaccgtaaaggaaccaacattcgaagctacccaacaaatgatggcacacgataaaattgctttgttagcaataactggtggtcctggtatagttaacatgggtttaaagtctggtaaaaaggtcataggtgctggtgcaggtaacccaccttgcttggttgacgaaactgcagaaattgtcaaggcagcccaagatatagtagccggtgcttcctttgactacaatttgccatgtattgctgaaaaatctgttattgctgttgattgcattgccgaccaattgatacaacaaatgagagaatttggtgccatgcaaatcacagatccacaacaaattgctcaattaagagaagtctgtattcaaaaaggtgctgcaaataagtccttagtaggtaaaagtccagctaccatattggccgctgcaggtatcccatgccctgcaaaggaacctagattaataatcttggaagttccagctaacgatcctttcgtagttactgaacaattaatgccagttttgcctattgttagagtcgataacttcgaacaaggtttgcaattagctttgaaagttgaagatggtttgcatcacactgcaatgatgcattctcaaaatgtttcaagattaaacaaggccgctcacttgatgcaaacatctatattcgttaaaaatggtccatcatacgccggtatcggtgttggtgctgaaggttttaccactttcacaatagcaacccctactggtgaaggtacaacctccgccagaacctttggtagattaagaagatgtgttttgactaacggtttctcaattagatga

SEQ ID NO: 20 - DNA, 1425 bp, Artificial Sequence
  AADHtl
atggtagacatagacttaaagaacgtagaacaaatcgtcagaactgtattagcctcaatgcaaactcaacctcaagccgtccaacctgctgcaggtagaagagccgctccaggtgtttttactgaattggatgacgccgttgctgaagcatctacagcacaaagagccattagaaatttggctaccagagttaaagttgtcgaagcaataagaaaggcagccgaagcccatgctagagaattggctgaattagcagtcgccgaaacaggcatgggtagagtagaagataaattcgccaagaacgtttcacaagctagacacacaccaggtgttgaatgtttggctcctaccgcattaactggtgacagaggtttgaccttaattgaaaatgctgcatggggtgtcatagcttccgtaacaccaagtaccaaccctgccgctaccattattaacaacgcaatttctatgatctcagccggtaatactgtagtttttgctccacatcctgcagccaaaaaggtttctcaaagaactgtctcattgttaaacgaagcatccgttgctgcaggtggtccagataatgtcgtaactacagttttgaaccctgatattgctacagcacaaagattattcagttatccaggtattcatttgttaacagttaccggtggtgaagctgttgtcgaagccgctagaaaacacactgataagagattgatcgcagccggtgcaggtaatccacctgtagttgtcgatgaaacagccgacttagctagagctgcaagagatatagtttggggtgcttccttcgataacaacatcatctgtgttgacgaaaaggaaatcatcgtagttgatagagtctgcgacgcattgaaaactgaaatggcaagacataaggccgttgaattgacaccagatcaaggtaaaagattagttgacgtcttgttgaactatgttggtgctgatggtagaggtactgtatctagagattgggttggtagagatgctgctaagatcgcagccgctattggtttggaagttccagctgataccagattgttatacattgaaactccagctgaccaccctttcgcagtcacagaattaatgatgccagtaatacctgttgttagagcaccagatgttgatgcagccattgatttggcagtaaagttagaaggcaactgtagacataccgctgcaatgcactctagaaacattgatgctttagacagaatggccaacgctataaacacatcaatcttcgttaagaatggtccatgcttggcaggtttaggtttcggtggtgaaggttggaccactatgactatttccactcctacaggtgaaggtgttacttctgctagaacatttgtcagattgagaagatgcgtattagttgatcatttcagaattgtttga

SEQ ID NO: 21 - DNA, 2739 bp, Artificial Sequence
  AADHtm
atggatacagccgtagccgttcaaaaacaagatattgccatgtctgccgccagtaagcctaagtctgcctcaggtcctcctttcgatgtccaagcacatgtagatggtttagttgcaagagccattagagctttagcagaatttcaagctttggatcaagaacaagttgatagaatagtagccaaggcttcagttgctgcattaaatcaacacggtgttttggcaaaattagccgtcgaagaaacaggtagaggtttgtttgaagataaagcagtcaagaacatgttcgcctgtgaaaacgtaacatctgcaatgaagagaatgaaaactgtaggtgttattcatagagataacttgaacggtatagtagaaatagctgaaccagttggtgttgtcgccgctgtaactcctgttacaaacccaaccagtactgcaatttttaaggccttggtttgtttaaaaactagaaaccctatcgtctttggtttccatccacacgctcaaaagtgctctgcagaagccgtcagaattgtaagagatgcagccgtcgctgcaggtgctccaaccaactgtgcacaatggatagaagttccttcaatcaaagctactggtgcattaatgaatcacccagatatctccgtaattttggccaccggtggtgacgctatggttaaggccgcttattcatgcggtaaacctgctattggtgttggtcctggtaacgttccagcatttgtcgaaaagactgccgatgttgctagagcagcctatgacttggtcttatctaaatcattcgattatggtatggtctgtgcatcagaacaagctgcaattatagaagccccagtatacgaccaagctatggcagaaatgcaaagattacatgcacacgttgccacttctgatgaaaagagaaagttggaagaattagcatttggtgtagttgccaacagtgaaaattgcggttctgctaagttgaacccagcaatcgttggtaaatccgctagttggttggctaaacaagcaggtttcagtgttcctcaagatacatctatcttgttagtagaagcagatcatgttggttatgacgaaccattgaccagagaaaagttgtgtcctatcttggctgttattagagccagagatgctgatgacggtatcagattatctgaacaaatggttgaacaagacggtttgggtcattcagcatgcattcactccactgatgaagaagtcatcgaaaagttcggtagaagaattaaagctgtaagaatcataactaactctccaacatcattaggtggtataggtgacatctataatgctttcgttccttcattgacattaggttgtggtacctacggtaaaaattctgtttctaacaacgttcaagctgtcaacttgattaatgtcaagagaatcggtcatagaaacaacaacatacaatggtttaaagttcctgctaagatctatttcgaaccaaacgccatcagatacttagctgacatgagaagagtaaacagagtttttatcgtcaccgatgctactatgtcaaaattgggtgtcgtagatagaattagagatgttttgaacagaagattaaacatggttaccatgcaagttgtcgatactatagactctgaaccatccatcagtatggtcgaagtaggtgctgaacaaatgagaaatttccaacctgacacaattgttgctttaggtggtggttctgcaatggatgccgctaaggtcatgtggttgttatatgaacacccagaagtctctttttcagatgtacgtgaaaagtgtttcgacgttagaaaaagagcttttactttccctgatttgggtgaaaaagcacaattggtatgcatatccactacaagtggtactggttctgaagttacaccttttgcttgcatcaccgatccaaaaactggttataagtaccaattgacagactacgccttaatgcctaccgtagctattgttgatccaactttagttaacgctatgccttcaagattggcagccgattccggtatggacgccttagctagagcaactgaagcatatgtttcagtctacgccaacgattttacagacggtttggcaatgcaagccattaaattgatcttcgaaaatttgccagcatccgttttgaaaggtgacgctaaggctagagaaaagatgcataatgctggtacaatagctggtatggcatccggtagtgcatttttgggtatagttcatgcaatcacacacaccattggtgcctcctatagaattagtcaaggtagatctaacgctactttgttgccattgggtattagatacaacggtagaataccaacaaagttgacctcttggcctaaatatgaaaagtacgttgctccacaaagataccaagatattgcaaagatgttgggtttacctgctgcaactccagaagaaggtgtcgaaagttatgcaagagccgtagaagatttgagagctacattgaacatggaatactcttttagagcacaaggtatagaagaacatgatttcgttgctaacttagacgaaatggccttcagagcttcagatgaccaatccgctccagcaaatcctagattaccaatggttgaagatttgaagatcatcatggaagccgcttattacggtatcagtttcgatgacattgtagccagaagagcctctgctcaattggctaaatctgaagtttctaagaaaggttga

SEQ ID NO: 22 - DNA, 1599 bp, Artificial Sequence
  AADHvs
atgaacgaacaagaaatcgcccacgcagtagaaaatgtattatcaaagtacaccaacgtaaccgcacaaaacgccgaaccagtaagttattcttcaaacgctagtttggaaaacattgtatctcaagccttagctggtaacatggttaaacaaccagaaacacaaaccgcacctgatttgaactctaacatcgaaaacatagtttcccaaatcttggccgaaaaccaagctaagccacaatcagttcaatgtcaatccgctaatcatggtactacagaatatttgggttgctttgcctctatggaagaagctatttctgctgcatcacatgcacaagttcaatacagacactgtactatgggtgacagagcctcatttgtcaaaggtataagagaagtattcactcaagatgacgttttggaaaagatctccagaatggcagttgaagaaaccggtatgggtaattacgccgataaattaactaagaacagaatagccgctactaaaacaccaggtatcgaagatttgaccacttccgctttaagtggtgactctggtttgaccttaactgaattttctgcatatggtgttatcggttctattacaccaacaaccaaccctacagaaaccattattaacaactcaatcggcatgttggcagccggtaatactgttgtctactccccacatcctagaagtagaaatgtttctttggttgctgttgatttgattaatagaaagttggcagaattaggtgcaccagccaatttggtagttactgttttagaaccttcaattgataacacaaacgctatgatgaacgacccaagagtaaacatgttagttgcaacaggtggtccttcaatcgtcaagactgtaatgtccacaggtaaaaaggctattggtgctggtgcaggtaatccacctgcagtcgtagatgaaactgccaacatagaaaaggctgcaaaggatatcattaatggttgtgcctttgacaataacttgccatgtattgctgaaaaagaagtcattgttgtcaatgaagtagccgattatttgatacactgtatgaaaaagtcaggtgcttacttgttatgcgacaagcaaaagatacaacaattgcaaagtttggttttgaacgaaaaaggtaccggtccaaacacttcttttgtcggtaaaggtgctagatacatcttggataagttgaacatccaagtttctgatgacattaaggtcatattgatcgaaacagaaagaaatcatcctttcgtagttcacgaattgatgatgccaatattacctgtcgtaagagttgaaaatgtcgatgaagcaatagacttagccatcaaagttgaacatggtaacagacacacagctataatgcatagtaccaacgttgaaaagttgtctaagatggcaagattaatccaaactacaatcttcgtcaagaatggtccatcctatagtggtattggtgtaggtggtgaaggtcacaccacttttacaattgctggtcctaccggtgaaggtataacttcagctagatccttcgcaagatacagaagatgtgtaatggttgaagcattaaatattagatga

SEQ ID NO: 23 - DNA, 2676 bp, Artificial Sequence
  ADHec
atggcagtcacaaatgtagccgaattgaacgccttagtagaaagagtcaagaaagcccaaagagaatacgcaagttttacacaagaacaagttgataaaatattcagagccgctgcattggccgcagccgacgcaagaatccctttggcaaagatggctgtagcagaaagtggtatgggtattgttgaagataaagttatcaaaaaccattttgcttccgaatatatctacaatgcctacaaagatgaaaagacctgcggtgttttatcagaagatgacacatttggtaccatcactattgcagaaccaattggtattatctgcggtattgttccaaccacaaacccaacatcaactgccatcttcaaatcattaatatccttaaaaactagaaatgcaattatcttttcacctcacccaagagccaaagatgctaccaataaggctgcagacatcgttttgcaagcagccatagccgcaggtgcacctaaggacttaattggttggatagaccaaccttcagttgaattatcaaacgcattgatgcatcacccagacataaacttgatcttagcaacaggtggtcctggtatggttaaggcagcctacagttccggtaaaccagcaatcggtgttggtgctggtaatacaccagtagtcatagacgaaactgctgatatcaagagagctgtagcctcagttttaatgtccaagacatttgataatggtgttatctgtgcatctgaacaatccgttgtagttgttgattcagtctatgatgccgttagagaaagattcgccactcatggtggttacttattgcaaggtaaagaattaaaggctgttcaagatgttatcttgaagaacggtgctttgaatgctgcaatagtaggtcaacctgcttataaaatagccgaattggcaggtttttccgtacctgaaaacacaaaaatcttgattggtgaagtaacagtcgttgatgaaagtgaaccttttgcacatgaaaaattgagtcctactttggcaatgtatagagccaaagatttcgaagatgcagtcgaaaaggctgaaaaattagttgcaatgggtggtatcggtcatacatcatgcttgtacacagaccaagataatcaacctgctagagtaagttactttggtcaaaagatgaaaacagccagaatattgattaataccccagcatcacaaggtggtattggtgacttatataactttaaattggcaccatcattgaccttaggttgcggttcctggggtggtaactcaatctccgaaaacgtcggtcctaaacacttgataaacaaaaagactgttgcaaaaagagcagaaaacatgttatggcataaattgccaaagagtatctacttcagaagaggttccttaccaatcgccttggatgaagttattactgacggtcataagagagcattaatcgttacagacagatttttgttcaacaacggttatgctgaccaaatcacatcagtattgaaagccgctggtgttgaaactgaagtctttttcgaagttgaagctgatcctacattgagtatcgttagaaagggtgctgaattagctaattcttttaaacctgacgttattatcgcattgggtggtggtagtccaatggatgccgcaaaaatcatgtgggtcatgtatgaacacccagaaacacacttcgaagaattagcattgagattcatggacatcagaaaaagaatctacaaattcccaaagatgggtgtaaaggccaaaatgatcgcagttacaacaacatcaggtaccggttccgaagtaaccccatttgcagttgtcacagatgatgccactggtcaaaaatacccattagctgattatgctttgacacctgatatggccatcgttgacgctaacttggttatggacatgcctaaatcattatgcgcttttggtggtttggatgcagttacccatgcaatggaagcttatgtttcagttttagcttccgaattttctgatggtcaagctttacaagccttaaaattattgaaagaatacttgccagcatcatatcatgaaggttccaagaatcctgttgccagagaaagagtacattcagccgcaactatagccggtattgcattcgctaatgcatttttaggtgtttgtcattcaatggcccacaagttgggttctcaatttcatataccacatggtttggcaaatgccttattaatttgtaacgttatcagatataacgccaatgacaatccaactaaacaaacagcattttcccaatacgacagaccacaagcaagaagaagatacgcagaaatcgcagatcatttgggtttgtctgcacctggtgacagaaccgcagctaagattgaaaagttattagcatggttggaaaccttaaaggcagaattgggtatcccaaagtctattagagaagcaggtgtccaagaagcagatttcttagccaatgtagacaagttgtccgaagatgcattcgatgaccaatgcacaggtgcaaatccaagatatccattgatctccgaattaaaacaaatattattggacacatactatggtagagattatgtagaaggtgaaaccgcagccaagaaagaagcagctccagctaaggcagaaaagaaggctaaaaagtccgcttaa

SEQ ID NO: 24 - DNA, 2658 bp, Artificial Sequence
  AHEpm
atgtctggtttacaaatgttccaaaacttgtccttatacggttctttagccgaaatagatacctctgaaaaattgaatgaagctatggacaaattgacagccgcacaagaacaattcagagaatataaccaagaacaagttgataagatctttaaggccgtcgcattggcagcttcacaaaacagagttgctttcgcaaaatacgcacacgaagaaactcaaaagggtgtttttgaagataaagttatcaaaaacgaatttgcagctgattatatctaccataaatattgtaacgacaagactgcaggtattatcgaatatgatgaagcaaatggtttaatggaaatcgcagaaccagttggtcctgttgttggtatcgcacctgttacaaacccaacatccactatcatatataagtcattaatcgcattaaagacaagaaattgcattatattctccccacatcctggtgcccataaagcttcagtttttgtagtcaaggtcttgcaccaagcagccgtaaaagctggtgcaccagaaaactgcatccaaataatctttccaaagatggacttgactacagaattgttacaccatcaaaagaccagattcatttgggcaaccggtggtccaggtttggttcatgcctcctatacttccggtaaaccagctttaggtggtggtcctggtaatgctccagcattgattgatgaaacttgcgatatgaatgaagccgtaggttctatcgtcgtttctaaaacattcgactgtggtatgatctgcgcaacagaaaacgcagttgttgtagttgaaagtgtttacgaaaactttgttgcaactatgaagaaaagaggtgcatatttcatgactccagaagaaaccaagaaagcatcaaacttgttattcggtgaaggtatgagattgaacgctaaggcagttggtcaaaccgctaaaactttggctgaaatggccggtttcgaagttcctgaaaacacagttgtcttgtgtggtgaagcttccgaagttaaatttgaagaacctatggctcatgaaaaattaactacaatcttaggtatatataaggcaaaggattttgatgacggtgttagattgtgcaaggaattggtcacatttggtggtaaaggtcatacagcagttttatatacaaatcaaaataataaggatagaatcgaaaagtaccaaaatgaagttcctgcatttcatatcttagttgatatgccttcttccttgggttgcattggtgacatgtataactttagattagcaccagccttgacaatcacatgtggtactatgggtggtggttccagttccgacaacatcggtccaaagcacttgttaaatattaaaagagttggtatgagaagagaaaacatgttatggttcaaaattcctaagagtgtttacttcaaaagagccattttatctgaagctttatcagacttgagagacacccataagagagcaataatcatcaccgatagaactatgactatgttgggtcaaacagacaagatcattaaagcatgcgaaggtcacggtatggtatgcactgtctacgataaggttgtcccagatcctacaatcaagtgtatcatggaaggtgttaacgaaatgaacgtattcaagccagatttggccattgccttgggtggtggttcagctatggatgcagcaaaaatgatgagattattttacgaatatccagatcaagacttgcaagatattgccacaagattcgttgacatcagaaagagagtagttggttgtcctaaattgggtagattaatcaagactttagtctgtatacctactacatcaggtaccggtgcagaagttaccccatttgcagttgtcacatccgaagaaggtagaaaatatcctttagtcgattatgaattaacccctgacatggctattgttgatccagaatttgccgttggtatgccaaagagattgacatcatggactggtatcgacgcattgactcacgcaatcgaatcctatgtcagtattatggcaactgactttacaagaccttattcattgagagcagttggtttaatttttgaatccttgtcattagcctataacaatggtaaagacattgaagctagagaaaagatgcacaatgcttccgccattgccggtatggcctttgcaaatgcatttttgggttgctgtcattccgtagcccaccaattgggttctgtttatcacatccctcatggtttggccaatgctttgatgttgtcccacataatcaaatataatgcaaccgactctcctgttaaaatgggtacatttccacaatacaaataccctcaagcaatgagacactatgctgaaatcgccgaattattgttgccacctacccaagtcgtaaaaatgactgatgttgacaaagttcaatatttgattgatagagttgaacaattgaaagctgatgttggtattcctaaatccattaaggaaactggtatggtcaccgaagaagatttctttaacaaggttgatcaagttgctatcatggccttcgacgatcaatgtacaggtgctaacccaagatacccattagtctccgaattaaaacaattgatgatagatgcctggaatggtgtagtccctaagttataa

SEQ ID NO: 25 - DNA, 1380 bp, Artificial Sequence
  EUTEdz
atggaacactccgtcattgaaccaaccgtccctatgcctttgccagctatgtttgatgccccttcaggtatcttctcctccttagacgatgcagttcaagccgctactttagcccaacaacaattgtcatccgttgaattgagacaacaagtcataaaggcaattagagttgccggtgaaagatacgctcaagtcttggcagaaatggccgtcgcagaaaccggtatgggtagagttgtagataaatacattaagaatgtttcacaagcaagacatacaccaggtatcgaatgtttatccgctgaagtattaacaggtgacaacggtttgaccttgattgaaaatgcaccttggggtgttgttgcttccgttacaccatcaaccaacccagctgctacagttattaacaacgcaatttctatgatcgctgccggtaactcagttgtctttgcacctcatccatctgcaaagaatgtttccttaagaactatctccttgttgaataaggcaatagtagccacaggtggtccagaaaatttgttagtctctgttgcaaaccctaatatcgaaactgcacaaagattgtttagatatccaggtatcggtttgttggttgtaaccggtggtgaagctgtagtcgaagctgcaagaaagcataccgataaaagattaatcgctgcaggtgcaggtaatccaccagttgttgttgacgaaacagctgatatccctaaggcagcaagagccattgttaaaggtgcatcattcgataacaatattatctgtgccgatgaaaaagttttaattgtagttgacagagttgccgatgcattattggccgaaatgcaaagaaataacgcagtattattgactccagaacaaacagaaagattgttaccagctttgttatctgatatcgacgaacaaggtaaaggtagagttaacagagactacgttggtagagatgccgctaaattagcagctgcaatcggtttggaagtctcagaacatacaagattattgttggcagaaacagatgcagatcatccattcgctgttacagaattaatgatgccagttttacctgtcatcagagtcaagaacgttgatgacgcaattgctttggcagtcaaattggaatctggttgtagacatactgctgctatgcattcaaccaacataagaaatttgaatagaatggccaacgctataaatacatcaatattcgttaagaatggtccttgtatcgctggtttaggtttgggtggtgaaggttggacaagtatgacaatcagtaccccaactggtgaaggtgttacatcagctagaacctttgttagattgagaagatgcgtcttagtagatatgtttagaatagcctaa

SEQ ID NO: 26 - DNA, 1404 bp, Artificial Sequence
  EUTEec
atgaaccaacaagacatagaacaagtagtaaaagccgtattattgaagatgcaaagttccgacactccaccagccgccgtccacgaaatgggtgtattcgcatcattagatgacgcagttgctgccgctaaagttgcccaacaaggtttgaagtcagttgctatgagacaattggcaattgctgcaattagagaagctggtgaaaaacatgccagagacttggccgaattagctgtctcagaaactggtatgggtagagttgaagataaatttgccaaaaacgttgcacaagctagaggtactcctggtgtagaatgtttgtccccacaagttttaacaggtgacaacggtttgaccttaattgaaaatgccccttggggtgttgtagcttctgtcacaccttcaaccaaccctgctgctaccttgatcaataacgctatttccttgattgctgccggtaattccgttatcttcgctccacatccagcagccaagaaagtttcacaaagagccatcaccttgttgaatcaagcaatcgttgctgcaggtggtccagaaaacttattggttacagtcgcaaaccctgacatcgaaacagctcaaagattgtttaaatttcctggtataggtttgttagttgtaactggtggtgaagctgtagttgaagcagctagaaagcatactaataagagattgattgctgcaggtgccggtaatcctccagtcgttgttgatgaaacagcagatttggccagagctgcacaatccatcgttaagggtgcatctttcgataacaatattatctgtgcagatgaaaaggtcttaatcgttgtagattccgttgctgatgaattgatgagattgatggaaggtcaacatgcagtcaaattgacagctgaacaagcccaacaattgcaacctgtattattgaagaatatcgacgaaagaggtaaaggtaccgtttcaagagactgggttggtagagatgctgcaaaaattgctgcagctatcggtttaaacgttcctcaagaaaccagattgttgtttgttgaaactaccgcagaacaccctttcgcagttaccgaattgatgatgcctgtattgccagtagtcagagttgccaacgttgctgatgcaatagccttggcagttaaattggaaggtggttgtcaccatacagcagctatgcattcaagaaatatagaaaatatgaaccaaatggctaacgcaatagacacatctatctttgttaagaacggtccttgcatagctggtttgggtttaggtggtgaaggttggacaaccatgacaatcactactccaacaggtgaaggtgtcacatcagcaagaacctttgttagattaagaagatgcgtcttggtagatgcctttagaatagtataa

SEQ ID NO: 27 - DNA, 1410 bp, Artificial Sequence
  LIN1129li
atggaatcattagaattagaacaattagtcaagaaggtattattagaaaagttggcagaacaaaaggaagtccctacaaagaccacaacccaaggtgcaaaatctggtgtattcgatacagttgacgaagccgtacaagcagctgttatagctcaaaattgttacaaggaaaaatccttggaagaaagaagaaatgttgtaaaagcaataagagaagccttatacccagaaattgaaactatagctacaagagcagttgctgaaactggtatgggtaacgttaccgataaaattttgaagaataccttggctattgaaaagacccctggtgtagaagatttgtacacagaagtcgctacaggtgacaatggtatgaccttgtatgaattatcaccatacggtgttattggtgctgttgcaccttctaccaacccaaccgaaacattaatttgtaactctattggtatgttagcagctggtaatgccgtattttattcaccacaccctggtgccaaaaatatctcattatggttgattgaaaagttgaataccatagttagagattcctgtggtatagataacttgatagtaacagtcgctaaaccaagtatccaagctgcacaagaaatgatgaatcatcctaaggttccattattggttataaccggtggtccaggtgttgtcttgcaagcaatgcaatccggtaaaaaggttatcggtgcaggtgcaggtaatcctccaagtatagttgacgaaactgctaacatagaaaaagcagccgcagacatcgttgatggtgcctcatttgatcataatatcttgtgtatagctgaaaagagtgtcgttgctgtagattccattgccgatttcttgttatttcaaatggaaaagaatggtgcattgcatgttaccaacccttctgatattcaaaaattagaaaaggtagccgttacagataagggtgtcactaataagaaattagttggtaaatccgccactgaaatcttgaaggaagcaggtatagcttgtgactttacaccaagattgataatcgttgaaaccgaaaaatcccatccatttgcaacagttgaattgttaatgcctatcgttccagttgtcagagttccagatttcgatgaagcattggaagttgctattgaattagaacaaggtttgcatcacacagctactatgcactctcaaaatatttccagattgaataaggcagcaagagatatgcaaacaagtatcttcgtcaaaaatggtccttcttttgcaggtttgggtttcagaggtgaaggttcaaccacttttacaattgccactccaaccggtgaaggtactaccacagccagacatttcgccagaagaagaagatgcgtcttgacagatggttttagtattagataa

SEQ ID NO: 28 - DNA, 6702 bp, Artificial Sequence
  ACC1sc
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactagctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 29 - DNA, 6702 bp, Artificial Sequence
  ACC1sc_s659A/s1157A
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactagctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgttgctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 30 - DNA, 6702 bp, Artificial Sequence
  ACC1sc_s1157A
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgttgctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 31 - DNA, 6747 bp, Artificial Sequence
  ACC1ke
atgagtgaagaaaatttatttgaagattcatctgcaaaacgtcaatatgaaataacagattactccaagaaacataaggcattggctccacattttgtagggttaaatacacttgacaaagtcgaagaatctccactaaaagattttgttaagtctcatggtggtcatactgttatctccaaaattttaattgctaataatggtattgccgcagttaaagaaattcgttcagttagaaaatggtcttatgaaacatttggtgatgaaagaactgttcaatttgttgcaatggctactccagaagatttacaagctaattctgaatatattcgtatggctgatcaatacgtcgaagttccaggtggtacaaataataacaattatgccaacgttgatctaattgttgatgtagcagaaagaacagatgtcgatgcagtatgggccggttggggtcatgcttctgaaaatccacatttaccagaaaaattggctgcatcaaagagaaagattatattcattggtcctccaggtagcgctatgagatctttaggtgataaaatttcttctacaattgttgctcaacatgccaaggttccttgtatcccatggtcaggtactggtattgataaagttcacgttgacgaaacctctggtttagtgtctgttgatgatgatgtttaccaacaaggttgttgccaatctccagaagatggtttagccaaagctaaacagattggtttcccagttatgatcaaagcttccgaaggtggtggtggtaaaggtatcagacaagttgaacgtgaagaagactttattgcattataccatcaagctgctaatgaaattccaggttctccaatctttatcatgaagttagctggcaaggctcgtcatttggaagttcaattattggcagaccaatatggtacaaatatttctctatttggtcgtgattgttctgttcaaagacgtcaccaaaaaattatcgaagaagctccagttacaattgctaacaatgaaacttttgacaagatggctaacgctgccgttagattaggtaaattggttggttacgtatcagctggtacagtcgagtatctatattcaaatgaagagaagaaatactatttcttagaattaaacccaagattacaagtggagcatccaactacagaaatggtctctggtgttaatttaccatctgcacaattacaaattgctatgggtatacctatgcacagaattagcgatattagagtgttatatggtatgaatccacattctgctactgaaatcgatttcgaatttaagactgaagaagctaagaagacacaaagaaaaccagttccaaagggtcattgtaccgcttgtcgtattacatccgaagatccaaacgaaggattcaaaccatctggtggttctttacacgaattgaatttcagatcctcatctaatgtttggggttatttctctgtcggtaacaacggtggtatccattcattctccgattctcagtttggtcatatctttgcctttggtgaaaacagacaaatgtcaagaaaacatatggtggtagcattaaaggaactctctattagaggtgatttcagaactactgttgaatatttgatcaaacttttggaaaccgaagattttgaagaaaatacaattacaactggttggttagatgatctaatttctcataagatgactgcagaaaaacctgacgctacgttagctgttatctgtggtgctgctacaaaggcttttatcgcttctgaatctgctcgtatggaatacattgctcaattaaagagaggtcaagtcccagctaagaacctattagagactatgttccctgtcgaattcattcatgaaaataagagatacaaattcactgttgctaaatctgctgacgactcttatactttatttattaatggttccaagtgtgaagtccgtgccgttaaattatctgatggtggtttgctaatatctgttggtggtcaatcccataccatctattggaaggaagaagctcaagctaccagattatctatcgattctatgaccactttactagaagttgaaaatgatccaacccaattacgtactccatccccaggtaaattagttaaattcttagttgaaaatggcgatcaaattaaggtaggccaagcatatgccgaaattgaagttatgaaaatgcaaatgcctctggtttctcaagaaaatggtgtaatacaattattgaaacaacctggttctactattgctgccggtgatattattgctatgcttgctctagatgatccatccaaggttaaacatgctttaccttttgaaggtatgttaccagaattaggttccccaatggtcgaaggtactaagcctgcttataaattcaagtcattagtttctactttagaaaatatattaaagggttacgataaccaagtcatcatgaatgcatctctacaacaattaattgaagttttaagagatccaagattaccatactctgaatggaaactatgtgtttctgcattacactccagattgccaatgtcacttgatgaaaaactagatcaacttgttgaccgttctagtaatagaaatgctatcttcccagctaaacaattaaacaagatgattgaagatgctgttagagaacctggatctgatgagttactgccaacaatcgttgagccactattagatatcaccaatcgttatgccaatggtcttgaagctcacgaacattccgtttttgtcaaatttttggaagaatactacaatgtcgaaaagttgtttagttcccatggtaaccgtgaagaaaatgtcattttgaaattacgtgatgaaaatctagattctttagacaaggtcgtcgaaatagtcttatcgcatgctaaggtatctgccaagaacactttaatcctagctattttgaagcactaccaaccaatttgtaagatgtcttcttctgttgctcatatttttagtaaatcattaggtcacatcgtggaattagaatcaaagtccgctgccaaggttgcgttacaagcaagagaaatcttaatccaaggtgctttaccatctgttaaagaaagaaccgaacaaattgaacacatcctaagatcttctgttacaaacacatcttatggtgatttggctccaaagaaatcagaaccaaacttagaaattctaaaggatttaatcgattccaactatgttgtctttgatgttctgttaccatttttatgccacgaagatccagtcatcgctactgctgctgctcaagtttacgtgcgtcgtgcttacagagcttacactgttggtgaagttaagactccaaatattaaggattcatctattagtccattaattgaatggaaattccaattgccttctgctgcattttcttctattccacaggtcaagagcaaaattggtatgaacagagctatgtctgtttctgatctttcttacgttgttgataatgaacatgctcctttaagaacaggtattttagttgcgtctgaacatttagacgatgtcgatgcttgtctagcccaaggtttggaagctattccagaacatgctaatactgctaatggtccagctccagatagatctggtaattcatcctctttgagtaatgttgccaatgtctgtgtctcaagtactgaaggttttgaatctgaaaaagatattttagcaagagttcacgaaatcttggatttgaacaaatctgatttaatcaagtcttctatccgtcgtattacattcatgtttggtttcgcagatggtacatatccaaagtattacacattcaacggtccaaattaccaagaaaatcaaactattcgtcatatcgagccagcttgtgcattccaattggaattaggaagaatgtctaactttaatatcaagccaatctttacagaaaatagaaatatccatgtttatgaagctatcagtaaaacatctgcattagataagagattctttaccagaggtattattagaactggtcgtatccgtgacgaaatttcaattcaagaatatcttacttctgaagctaacaagttaatgagtgacattttagataatctagagattgttgacacatctaactctgatttgaaccatatctttatcaacttttctgctgtctttgatgtttctccagaggatgttgaagctgcttttggtgggttcttagaaagattcgggaagagattcttaagacttcgtgtttcagctgctgaaattcgtattattattcaagacccaaagacaggtgcggctgttccattacgtgctttaatcaacaatgtttctggttacgtagttaaatccgagctatacactgaaattaagaatgataagggagaatgggtctttaagtcactaggtaaacctggttcaatgcatttgagaccaattgctactccatatccagttaaggaatggttacaacctaaacgttataaggctcatttaatgggtaccacttatctatacgatttcccagaattattccatcaagctgccattaccacatgggagaaatatctatctaactcgtcagctaaggaattatcatctataaaggacagagacgatttatttatttctcacgaattgatcgaagatgaaaatggtgaattaactgaggtcgaaagagaacctggtgccaatactattggtatggttgcatttaaggtcacaatgaagactccagaatatccaagaggtcgtcaatttgtaattgttgctaatgatatcactttcaagattggttcctttggtccacaagaagatgaatttttcaacaaagttactgaatatgctagaaagagaggtattccaagaatatacctggctgctaactctggtgccagaattggtatcgctgaagaattggtgccattattccaagttgcttggaaggattctaaggttccagcaaagggtttcgaatatttatatttgagcaaagaaggtatggaaacattaaagagttattctaagcagaattctgttatcactgaacgtgtcgttgaagaaggtgaagaaagatatgttatcaaatctattattggtgctgatgatggtttaggtgttgaatgtttaagaggttccggtttaattgccggtgctacatcaagagcttaccaagatattttcacaattactttagttacatgtagatctgtcggtattggtgcttatttggttagattaggtcaaagagccattcaaattgaaggtcaaccaattattttaactggtgcaccagctatcaataaagtgttaggtagagaagtttattcttctaatttacaacttggtggtactcaaattatgtacaataatggtgtttctcatttaacagcttcagatgatttacaagctgttgaacaaatcattaattggttatcttatgttccggcaaagcgtaatatgcctgttccaatcttagaaaccgaagataaatgggatagagccattgatttcagaccaactaccaatgaacaatatgatgtcagatggttaatccaaggtcgtgaattagacaacggtgatttcgaatacggtatgtttgataagggttccttctttgaaactttatctggatgggctaaaggtgttgttgttggtagagctcgtttaggtggtattccaatcggtgtcattggtgttgaaacaagaaccattgaaaatgttattccagctgatccagcaaatccagattctaccgaaactgttgtccaagaagctggtcaagtttggtatccaaattctgcatttaagacggcacaagctattcaagactttaaccacggtgaacaattaccattaatgattctagccaattggagaggattctctggtggtcaacgtgatatgtacaatgaagtattgaaatatggttcatttattgttgatgccttggttgattacaaacaacctatctttatctatattccaccaactggtgaattaagaggtggttcatgggtcgtcgttgatccaactattaataatgatcatatggaaatgtatgctgataaagattcccgtgctggtgtgttagaaccttcaggtatggttggtattaaataccgtagagagaaattgttatctactataacaagattagattctacctatagagaattgaaagaaaaattatctgataaattgttatctactgaagaacatcaaaagatttctatacaactagctgaacgtgaaaagatgttaattccaatctataatcaaatcagtgtccaatttgctgatctacatgatagatcatctcgtatgttaaagaaaggtgttattaaagctgaattgacatgggaagaatctcgtcgttatttcttctggagattaagaagaagattagatgaagaatacttattaagaagattagattctcaattaacccaagcttcaagattagagaagattgcacgtgttagatcctggtatccaacttctgtcgatgtggagaacgataaagaagtagttacatggattgaagaaaattatgaaacattagaagagaaattcaaagcccttaaattggaatcatttgctttagatttagctaaaaatattagaaatgatcatgaaaatagtatgaagggtttagaagaagttgttcgtatgttaagtgcaacagataaagaaagattaaataagattattaatccagatgataaaaaataa

SEQ ID NO: 32 - DNA, 6651 bp, Artificial Sequence
  ACC1mc
atggtcgaacataagagcttgcctggccactttttaggtggtaattcactcgaatctgctcctcagggtcccgtcaaagactttgtccaagcacatgagggtcacacagtcatttccaaagtcttgattgccaacaacggtatggctgcaatgaaggagatccgttccgtaagaaagtgggcttacgagacatttggtaacgagagagctatcgaattcactgtcatggcaacacccgaggatttgaaggccaatgctgaatacatccgtatggccgataactttgtcgaggttcccggtggatccaacaacaacaactatgccaatgttgaactgattgtcgacgttgccgaaagaactgctgttcatgctgtttgggccggttggggtcatgcttccgagaatcctcgtttgcctgaaatgcttgccaagtccaagcacaagtgtttgtttattggtcctcctgcctctgccatgagatcattaggtgacaaaatttcatctacaatcgttgcacagagcgctcaagtccccacaatgggttggagtggtgatggtattaccgagacagagtttgatgctgcaggccacgttatcgtccctgacaatgcttataacgaagcctgtgtcaagactgccgagcaaggtctcaaggctgccgagaagattggtttccctgtcatgatcaaggcctccgaaggtggtggaggtaaaggtattcgtatggtcaaggatggatccaactttgcccaattgtttgcccaagtgcaaggtgaaatccctggttctcccatctttatcatgaagctggctggtaacgctcgccacttggaagtccaattgttggccgatcaatacggtaatgctatcagtttgtttggtcgtgattgttcagttcaacgtcgtcaccaaaagatcatcgaagaagctcctgtcaccattgccaagcctgatgtctttgagcaaatggagaaggctgctgtcagactcggtaaattggtgggctatgtctctgctggtaccgtggaatatctctacagtcatcacgacgatcaattctacttcttggaattgaaccctagattgcaagtcgagcatcctaccaccgagatggtttctggcgtcaatttgcctgctgctcagctccaaattgctatgggtattcctcttcaccgtatccgcgatattcgtgtcctctacggtgtccaacccaacagtgcctctgaaatcgatttcggtttcgagcaccccacctctctcaccagccatcgtcgccccacccccaagggccacgttattgcttgtcgtatcactgctgagaatcccgatgctggtttcaagccttcttctggtatcatgcaagaactcaatttcagatcgagcacaaatgtttggggttacttttctgttgtctctgctggtggtttgcacgagtatgctgattctcaatttggtcacatctttgcctatggtgagaaccgtcaacaagctcgcaagaacatggttattgctctcaaggagctctccatccgtgctgatttccgtagtaccgttgaatacattatccgtttgctcgagacccctgatttcgaagagaacaccatcaacaccggttggttggatatgttgatttccaagaagttgactgccgaacgtcctgataccatgttggctgtcttctgtggtgctgtcaccaaggctcatatggcctctttggattgtttccaacaatacaagcaatccctcgagaagggtcaagtgcccagcaagggttctctcaagactgtctttactgttgatttcatctacgaggaagtgcgctacaactttactgtcacccaatctgctcctggtatctacaccttgtatttgaacggcaccaagactcaagttggtatccgcgatttgtctgatggcggtctcttgatctctattgacggtaaatctcacactacttactctcgcgatgaagttcaagccacccgtatgatggtggatggtaagacctgtcttttggaaaaggagagtgatcctactcaattgagaagtccttctcctggtaagcttgtcaacttgctcgttgagaatggcgatcatttgaatgctggtgatgcatatgctgaaattgaggtcatgaaaatgtacatgcccttgattgctactgaagatggtcatgttcaattcatcaagcaagctggtgctactcttgaggctggtgatatcattggtatcttgtctctggatgatcctagccgtgtcaagcacgcccttcccttcaacggcactgtacctgcctttggtgctcctcacatcactggtgacaagcctgtgcaacgcttcaacgctaccaagctcaccttgcaacacatcctccaaggttacgataaccaagctcttgtccaaactgttgtcaaggattttgccgatatcttgaacaaccctgacttgccttactctgaattgaactctgttctctctgctttgtctggcagaattcctcaacgcttggaagcctctatccacaagttggctgatgaatccaaggctgctaaccaagagttccctgctgctcaatttgaaaagcttgtcgaagactttgctcgtgaacacatcacccttcaatctgaagccactgcttacaagaactctgtcgctcccttgagcagcatctttgctcgctatagaaacggtctcaccgaacacgcctacagcaactatgttgaattgatggaagcttactacgacgtcgaaatcttgttcaaccaacaacgcgaagaggaggtcatcttgtcactcagagatcagcacaaggacgacttggacaaggtgttggctgttactttgtctcatgccaaggtcaacatcaagaacaatgtgatcctcatgttgctcgacctcatcaaccctgtctccactggcagtgctcttgacaagtactttactcctatccttaagcgtttgtctgaaatcgaaagccgtgccactcaaaaggtcactctcaaggcccgtgaattgttaatcctctgtcaattgccttcttacgaggaacgtcaagctcaaatgtaccaaattctcaagaactctgtcaccgagtctgtctacggcggtggttctgaataccgcactcccagctacgacgccttcaaggatctcattgacaccaagttcaacgtctttgatgtcttgcctcacttcttctaccatgctgatccttatattgccttggctgctatcgaagtatactgtcgtcgttcttaccacgcttacaagattttggatgtcgcttacaacctcgagcacaagccttacgttgttgcctggaagttcttgctccaaactgctgctaacggcattgactccaacaagcgtattgcctcttactctgatcttaccttcttgctcaacaagactgaggaagagcctatccgtactggtgccatgactgcatgcaactctttggctgatctccaagccgagcttcctcgcatcttgactgcctttgaggaagagcctctccctcccatgttgcaacgcaatgctgctcccaaggaagaacgcatggagaacattctcaacattgctgttcgtgctgatgaggacatggatgacactgctttcagaaccaagatctgtgagatgatcactgccaatgctgatgctttccgtcaagcccatttgcgtcgtctttccgttgtcgtctgccgtgataaccaatggcccgattactacactttccgtgagcgtgaaaactaccaagaagacgagaccatccgtcacattgaacctgccatggcctatcaactcgagttggctcgtctctccaactttgacatcaagccctgtttcattgagaacagacaaatgcacgtctactatgctgttgccaaggagaacccctctgactgccgtttcttcatccgtgccttggtccgtcccggtcgtgtcaagagctccatgcgcactgctgactacttgatctctgagagtgatcgtctcttgactgacattcttgacaccctcgaaattgtcagccacgagtacaagaactctgactgtaaccacttgttcatcaacttcatccccacttttgctattgaggctgatgatgtggagcacgccttgaaggactttgtcgatcgtcatggtaagcgtctctggaagctccgtgtcactggtgccgaaatccgcttcaacgtgcaatccaagaagcctgatgcccccatcatccccatgcgtttcaccgtggacaacgtctctggcttcatcttgaaggtcgaggtctaccaagaagtcaagactgaaaagagtggatggattctcaagtctgtcaacaagatccctggtgccatgcacatgcagcccttgtctacgccttatcctaccaaggaatggctccaaccccgtcgttacaaggctcacttgatgggcaccacctacgtctatgacttccctgagctcttccgtcaatctgttcaaaaccaatggactcaagccatcaagcgcaaccctctcttgaagcaacccagccatttggttgaagccaaggagttggtcctcgacgaagatgatgtcttgcaagagattgaccgtgctcccggtaccaacactgtcggtatggttgcctggatcatgactattcgcactcccgagtatcccagtggtcgtcgcatcattgctattgccaacgacattaccttcaagattggttcctttggtgttgctgaagatcaagtcttttacaaggcatctgagctcgctcgtgctcttggtattcctcgtatctacttgtctgccaactcgggtgctcgtatcggtcttgctgaagagctcatcagccaattcagagctgcctggaaggatgcttccaaccctactgctggtttcaactacctctacttgactcctgccgagtatgatactcttgttcaacaaggtgatgccaagagtgtgctcgtggaagagatccaagatgaaggtgaaacgcgtctccgtatcactgatgtcattggccacactgatggtcttggtgtggagaacttgaagggttctggtctcattgctggtgccacctcgcgtgcctatgatgatatcttcaccatcacgcttgtcacttgtcgttccgtcggtattggtgcttaccttgtccgtctcggtcaaagaactgtccaaaacgaaggccaacccatcatcttgaccggtgctcctgccttgaacaaggtgcttggtcgtgaagtctacacctccaacttgcagttgggtggtactcaaatcatgtacaagaacggtgtctctcacttgactgccgagaatgatttggaaggtattgccaagattgtgcaatggctctcattcgtgcctgatgtccgcaacgctcctgtctctatgcgcttgggtgttgatcccattgaccgtgacattgagtacactcctcccaagggtccctctgatcctcgcttcttcttggccggtaagagtgagaacggcaagtggttgagcggtttctttgatcaagactccttcattgagaccttgagtggttgggctcgtaccgttgtcgttggtcgtgctcgtttgggtggtattcctatgggtgttgtctctgttgagacccgtactgtggagaacattgttcctgctgatcccgccaattctgattccactgagcaagtctttatggaagctggtggtgtctggttccctaactctgcttacaagactgcccaagccatcaatgacttcaacaagggtgagcaattgcctttgatgatctttgccaactggcgtggtttctctggtggtcaacgcgacatgtacaacgaagtcctcaagtacggtgctcaaatcgtggatgctctcagcaactacaagcaacctgtctttgtctacattattcccaacggtgagcttcgtggtggtgcttgggtcgttgttgatcctaccatcaacaaggacatgatggaaatgtacgctgataacaatgctcgtggtggtgtcttggagcccgagggtatcgtcgagatcaagtaccgtaagcctgccttgttggctactatggagcgtcttgacgctacttatgcttctttgaagaagcaattggccgaagaaggtaaatctgacgaagagaaggctgccctcaaggtgcaaatcgaagctcgtgaacaagaactcttgcccgtataccaacaaatctctatccaatttgctgatctccatgatcgtgctggtcgtatgaaggctaagggtgtcatccgcaaggctcttgactggcgtcgtgctcgtcactacttctactggcgtgtccgtcgtcgtctctgtgaagagtacactttccgcaagattgttgctgccactagcgctgctcccatgtctcgcgagcaaatgcttgatctcgtcaagcaatggtttaccagcgacaatgaaactgccagcttcgaagatgctgatgaactcgtctctgaatggtttgaaaagcgtgccagtgtcattgatcaacgtatcagcaagttgaagagcgatgctaccaaggaacaagtcgtgtctctcggtaatgccgatcaagaagctgtcattgaaggtttcactcaattgattgaaaacttgagcgaagatcaacgtgctgaaatcttgcgcaagcttaattctcgtttctaa

SEQ ID NO: 33 - DNA, 6702 bp, Artificial Sequence
  ACC1sc
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 34 - DNA, 6801 bp, Artificial Sequence
  ACCyl
atgcgactgcaattgaggacactaacacgtcggtttttcagtatggcttcaggatcttcaacgccagatgtggctcccttggtggaccccaacattcacaaaggtctcgcctctcatttctttggactcaattctgtccacacagccaagccctcaaaagtcaaggagtttgtggcttctcacggaggtcatacagttatcaacaaggtcctcatcgctaacaacggtattgccgcagtaaaggagatccgttcagtacgaaaatgggcctacgagacctttggcgacgagcgagcaatctcgttcaccgtcatggccacccccgaagatctcgctgccaacgccgactacattagaatggccgatcagtacgtcgaggtgcccggaggaaccaacaacaacaactacgccaacgtcgagctgattgtcgacgtggctgagcgattcggcgtcgatgccgtgtgggccggatggggccatgccagtgaaaatcccctgctccccgagtcgctagcggcctctccccgcaagattgtcttcatcggccctcccggagctgccatgagatctctgggagacaaaatttcttctaccattgtggcccagcacgcaaaggtcccgtgtatcccgtggtctggaaccggagtggacgaggttgtggttgacaagagcaccaacctcgtgtccgtgtccgaggaggtgtacaccaagggctgcaccaccggtcccaagcagggtctggagaaggctaagcagattggattccccgtgatgatcaaggcttccgagggaggaggaggaaagggtattcgaaaggttgagcgagaggaggacttcgaggctgcttaccaccaggtcgagggagagatccccggctcgcccatcttcattatgcagcttgcaggcaatgcccggcatttggaggtgcagcttctggctgatcagtacggcaacaatatttcactgtttggtcgagattgttcggttcagcgacggcatcaaaagattattgaggaggctcctgtgactgtggctggccagcagaccttcactgccatggagaaggctgccgtgcgactcggtaagcttgtcggatatgtctctgcaggtaccgttgaatatctgtattcccatgaggacgacaagttctacttcttggagctgaatcctcgtcttcaggtcgaacatcctaccaccgagatggtcaccggtgtcaacctgcccgctgcccagcttcagatcgccatgggtatccccctcgatcgaatcaaggacattcgtctcttttacggtgttaaccctcacaccaccactccaattgatttcgacttctcgggcgaggatgctgataagacacagcgacgtcccgtcccccgaggtcacaccactgcttgccgaatcacatccgaggaccctggagagggtttcaagccctccggaggtactatgcacgagctcaacttccgatcctcgtccaacgtgtggggttacttctccgttggtaaccagggaggtatccattcgttctcggattcgcagtttggtcacatcttcgccttcggtgagaaccgaagtgcgtctcgaaagcacatggttgttgctttgaaggaactatctattcgaggtgacttccgaaccaccgtcgagtacctcatcaagctgctggagacaccggacttcgaggacaacaccatcaccaccggctggctggatgagcttatctccaacaagctgactgccgagcgacccgactcgttcctcgctgttgtttgtggtgctgctaccaaggcccatcgagcttccgaggactctattgccacttacatggcttcgctagagaagggccaggtccctgctcgagacattctcaagacccttttccccgttgacttcatctacgagggccagcggtacaagttcaccgccacccggtcgtctgaggactcttacacgctgttcatcaacggttctcgatgcgacattggagttagacctctttctgacggtggtattctgtgtcttgtaggtgggagatcccacaatgtctactggaaggaggaggttggagccacgcgactgtctgttgactccaagacctgccttctcgaggtggagaacgatcccactcagcttcgatctccctctcccggtaagctggttaagttcctggtcgagaacggcgaccacgtgcgagccaaccagccctatgccgagattgaggtcatgaagatgtacatgactctcactgctcaggaggacggtattgtccagctgatgaagcagcccggttccaccatcgaggctggcgacatcctcggtatcttggcccttgatgatccttccaaggtcaagcatgccaagccctttgagggccagcttcccgagcttggaccccccactctcagcggtaacaagcctcatcagcgatacgagcactgccagaacgtgctccataacattctgcttggtttcgataaccaggtggtgatgaagtccactcttcaggagatggttggtctgctccgaaaccctgagcttccttatctccagtgggctcatcaggtgtcttctctgcacacccgaatgagcgccaagctggatgctactcttgctggtctcattgacaaggccaagcagcgaggtggcgagtttcctgccaagcagcttctgcgagcccttgagaaggaggcgagctctggcgaggtcgatgcgctcttccagcaaactcttgctcctctgtttgaccttgctcgagagtaccaggacggtcttgctatccacgagcttcaggttgctgcaggccttctgcaggcctactacgactctgaggcccggttctgcggacccaacgtacgtgacgaggatgtcattctcaagcttcgagaggagaaccgagattctcttcgaaaggttgtgatggcccagctgtctcattctcgagtcggagccaagaacaaccttgtgctggcccttctcgatgaatacaaggtggccgaccaggctggcactgactctcctgcctccaacgtgcacgttgcaaagtacttgcgacctgtgctgcgaaagattgtggagctggaatctcgagcttctgccaaggtatctctgaaagcccgagagatcctcatccagtgcgctctgccctctctaaaggagcgaactgaccagcttgagcacattctgcgatcttctgtcgtcgagtctcgatacggagaggttggtctggagcaccgaactccccgagccgatattctcaaggaggttgtcgactccaagtacattgtctttgatgtgcttgcccagttctttgcccacgatgatccctggatcgtccttgctgccctggagctgtacatccgacgagcttgcaaggcctactccatcctggacatcaactaccaccaggactcggacctgcctcccgtcatctcgtggcgatttagactgcctaccatgtcgtctgctttgtacaactcagtagtgtcttctggctccaaaacccccacttccccctcggtgtctcgagctgattccgtctccgacttttcgtacaccgttgagcgagactctgctcccgctcgaaccggagcgattgttgccgtgcctcatctggatgatctggaggatgctctgactcgtgttctggagaacctgcccaaacggggcgctggtcttgccatctctgttggtgctagcaacaagagtgccgctgcttctgctcgtgacgctgctgctgctgccgcttcatccgttgacactggcctgtccaacatttgcaacgttatgattggtcgggttgatgagtctgatgacgacgacactctgattgcccgaatctcccaggtcattgaggactttaaggaggactttgaggcctgttctctgcgacgaatcaccttctccttcggcaactcccgaggtacttatcccaagtatttcacgttccgaggccccgcatacgaggaggaccccactatccgacacattgagcctgctctggccttccagctggagctcgcccgtctgtccaacttcgacatcaagcctgtccacaccgacaaccgaaacatccacgtgtacgaggctactggcaagaacgctgcttccgacaagcggttcttcacccgaggtatcgtacgacctggtcgtcttcgagagaacatccccacctcggagtatctcatttccgaggctgaccggctcatgagcgatattttggacgctctagaggtgattggaaccaccaactcggatctcaaccacattttcatcaacttctcagccgtctttgctctgaagcccgaggaggttgaagctgcctttggcggtttcctggagcgatttggccgacgtctgtggcgacttcgagtcaccggtgccgagatccgaatgatggtatccgaccccgaaactggctctgctttccctctgcgagcaatgatcaacaacgtctctggttacgttgtgcagtctgagctgtacgctgaggccaagaacgacaagggccagtggattttcaagtctctgggcaagcccggctccatgcacatgcggtctatcaacactccctaccccaccaaggagtggctgcagcccaagcggtacaaggcccatctgatgggtaccacctactgctatgacttccccgagctgttccgacagtccattgagtcggactggaagaagtatgacggcaaggctcccgacgatctcatgacttgcaacgagctgattctcgatgaggactctggcgagctgcaggaggtgaaccgagagcccggcgccaacaacgtcggtatggttgcgtggaagtttgaggccaagacccccgagtaccctcgaggccgatctttcatcgtggtggccaacgatatcaccttccagattggttcgtttggccctgctgaggaccagttcttcttcaaggtgacggagctggctcgaaagctcggtattcctcgaatctatctgtctgccaactctggtgctcgaatcggcattgctgacgagctcgttggcaagtacaaggttgcgtggaacgacgagactgacccctccaagggcttcaagtacctttacttcacccctgagtctcttgccaccctcaagcccgacactgttgtcaccactgagattgaggaggagggtcccaacggcgtggagaagcgtcatgtgatcgactacattgtcggagagaaggacggtctcggagtcgagtgtctgcggggctctggtctcattgcaggcgccacttctcgagcctacaaggatatcttcactctcactcttgtcacctgtcgatccgttggtatcggtgcttaccttgttcgtcttggtcaacgagccatccagattgagggccagcccatcattctcactggtgcccccgccatcaacaagctgcttggtcgagaggtctactcttccaacttgcagcttggtggtactcagatcatgtacaacaacggtgtgtctcatctgactgcccgagatgatctcaacggtgtccacaagatcatgcagtggctgtcatacatccctgcttctcgaggtcttccagtgcctgttctccctcacaagaccgatgtgtgggatcgagacgtgacgttccagcctgtccgaggcgagcagtacgatgttagatggctcatttctggccgaactctcgaggatggtgctttcgagtctggtctctttgacaaggactctttccaggagactctgtctggctgggccaagggtgttgttgttggtcgagctcgtcttggcggcattcccttcggtgtcattggtgtcgagactgcgaccgtcgacaatactacccctgccgatcccgccaacccggactctattgagatgagcacctctgaagccggccaggtttggtaccccaactcggccttcaagacctctcaggccatcaacgacttcaaccatggtgaggcgcttcctctcatgattcttgctaactggcgaggcttttctggtggtcagcgagacatgtacaatgaggttctcaagtacggatctttcattgttgatgctctggttgactacaagcagcccatcatggtgtacatccctcccaccggtgagctgcgaggtggttcttgggttgtggttgaccccaccatcaactcggacatgatggagatgtacgctgacgtcgagtctcgaggtggtgtgctggagcccgagggaatggtcggtatcaagtaccgacgagacaagctactggacaccatggctcgtctggatcccgagtactcctctctcaagaagcagcttgaggagtctcccgattctgaggagctcaaggtcaagctcagcgtgcgagagaagtctctcatgcccatctaccagcagatctccgtgcagtttgccgacttgcatgaccgagctggccgaatggaggccaagggtgtcattcgtgaggctcttgtgtggaaggatgctcgtcgattcttcttctggcgaatccgacgacgattagtcgaggagtacctcattaccaagatcaatagcattctgccctcttgcactcggcttgagtgtctggctcgaatcaagtcgtggaagcctgccactcttgatcagggctctgaccggggtgttgccgagtggtttgacgagaactctgatgccgtctctgctcgactcagcgagctcaagaaggacgcttctgcccagtcgtttgcttctcaactgagaaaggaccgacagggtactctccagggcatgaagcaggctctcgcttctctttctgaggctgagcgggctgagctgctcaaggggttgtga

SEQ ID NO: 35 - DNA, 6732 bp, Artificial Sequence
  ACC1ch
atgagcgaagaaaacctgttcgaggacgccgccgcaaagcgccagtacgagataacagactactccaccaagcacaagaccctcgcgtcccacttcgtcggcctcaacaccctcgagcgcgtcgaggagtcccccctcaaggacttcgtcaagtcccacggcggtcacaccgtcatctccaagatcctcatcgccaacaacggtatcgccgccgtcaaggagatccgctccgtcagaaagtgggcctacgagaccttcggcgatgagcgcaccgtccagttcgtcgccatggccacccccgaggacctccaggccaactccgagtacatccgcatggcggaccagtacgtcgaggtccccggcggcaccaacaacaacaactacgccaacgtcgacctcatcgtcgacgtcgccgagagaaccgacgtcgacgcagtctgggccggctggggccacgcctcagagaacccacacctcccagagaagctcgccgcctcaaagagaaagatcatcttcatcggtccacccggcagcgccatgcgctccctcggtgacaagatctcctccaccatcgtcgctcagcatgccaaggtcccatgtataccttggtccggcaccggcgtcgacacagtccacctcgacagcgagaccggcctagtgtccgtcgacgacgacatctaccagaagggctgctgctcctcccccgaggacggcctcgccaaggccaagaagatcggcttcccagtaatgatcaaggcctccgagggtggtggtggtaagggtatcagacaggtcgagcgcgaggaggacttcatcgccctgtaccaccaggccgccaacgagatcccgggctccccaatattcatcatgaagctcgccggcaaggcccgccacctggaggtccagcttctcgccgatcagtacggtaccaacatttccctgtttggccgtgactgttccgtgcagagacgccaccagaagatcatcgaggaggcgccagtgactatcgccagcaacgagacattcgagaagatggccagcgcagccgtcagactcggtaagctggtcggctacgtctccgccggtaccgtcgaatacctatattccagcgaggagaagaagtactacttcctggagcttaatccaagactgcaggtcgagcacccaaccaccgagatggtctccggtgtcaacctgccttccgcccagctgcagatcgccatgggtatcccaatgcacagaatcagcgacatcagagtcctttacggtatgaaccctcacggcgccaccgagatcgacttcgagttcaagactgaggaggccaagaagactcagagaaagcctgttccaaagggccattgtaccgcttgtcgtatcacttccgaggatccaaacgagggtttcaagccttccggtggttccctacacgagctgaacttcagatcttcttcaaatgtctggggttacttctccgtcggtaacaacggtggtatccactccttctccgactcccaattcggtcacatcttcgccttcggtgagaacagacagatgtcgagaaagcacatggttgtcgccctaaaggagctgtccatcagaggtgacttcagaactactgtcgagtatctgatcaagcttctagagactgaggatttcgaggagaacactattactaccggttggttggacgacctgatctcgcacaagatgaccgcccagaagccagatgctacgcttgccgtcatttgtggcgctgctaccaaggctttcatcgcgtcagagtctgccagaaaggaatacattaaccagctcaagagaggtcaggttccaccaaagggcctactggagactatgttcccaattgaattcatccacgagaacaagagatataagttcactgttgccaagtctgctgacgattcctacacacttttcatcaatggttccaagtgcgaggtccgtgctgttaagctatctgatggcggtcttttgatttctgtcggcggccaatctcacactatctactggaaggaggaagcccaggctaccagactttcgatcgactctatgactactctacttgaggttgagaatgatcctacacagctgcgcaccccatccccaggtaagcttgtgaagttccttgttgagaacggtgaccaaatcaaggtcggccagccatacgctgagattgaggtcatgaagatgcaaatgccattggtttctcaggagaacggtgttatccagttactaaagcagccaggttctaccattgacgctggtgatatcattgccatgcttgcgctagacgacccatccaaggtcaagcacgctatgccatttgagggtatgcttccagagctaggctctccaatggttgaaggtaccaagccagcctacaagttccactccctagtgtccacgcttgagaatattctaaagggttacgacaaccaggttatcatgaacgcatctctacaacagctaatcgaggttctcagagacccaagactaccatactctgagtggaagttaaatgtatctgcgctacacaccagacttcctcttgctttggacgagaagttggacaagctggtcgagcgttctgctaaccgcagtgctatcttccctgctaagcagctacagaagatgatcgatgatgctgtgagagacccacaagctgacccactattgtcatccattgttgagccactccttgacattactactcgttatgccaatggcctagaggcacatgaacattccgtctttgtcaagttcttagaggagtactacaacgtcgagaagctattcagcgagcacggtgagcgtgctgagaatgtcatcctaaagctacgtgacgagaacatcgatgacctagacaaggttgttctcattgttctctctcatgccaaggtttctgccaagaacactctgatcctagctattctgaagcactaccaaccaatttgcaaaatgtcttcgtctgttgcccatatcttcaccaagccacttcagcacattgtcgagctggagtccaagcctgctgctaaggttgctctacaggccagagaaattctgatccagggtgccctaccatctgtcaaggagagaacagagcagattgaacacattctaagatcttctgtcacaaacacttcttatggtgactcttcgccaaaggtcagtgagccaaacatggaaatactgaaggatctaattgactccaactatgtcgtttttgatgttctactcccattcctgtgtcacgaagaccctgttattgctactgccgctggtcaggtttatgttcgccgtgcttacagagcttacaccgttggtgaggttaagtcacacagcattactgactcttccatgaacccattgattgagtggaagttccagctaccctctgctgctttctcttccattccacagctgaagagcaagattggtatgaacagagctatgtctgtttctgacttgtcctacgttgttgacagtgagcacgctccactgagaactggtatattggttgctgctgaacatctagatgaggttgacgccagccttgcacagggcctagaggttatcccagagcactccgctccaggcaatggtccagctccagacagatctggcagttcctcctctttgagtaacatcgttaatgtctgtgttgccagcacagaaggattcgattccgaaaaggagattcttgccagagtgaacgagatcctagagctgaacaaggctgatctaatcaagtcttccatccgtcgtatcactttcatgttcggtttcccagacggtacttatccaaagtattacactttcaatggtccaaactaccaggagaaccagacgattcgtcacattgagccagcttgtgcgttccaactagaattaggaagaatgtctaacttcaacatcactccaatcttcactgacaacagaaacatccacgtttacgaagctgtcagtaagacttctgcactagacaagagattcttcactagaggtataatcagaaccggtcgcattcgtgacgagatttccattcaagaatatctgacctctgaagctaacaagctgatgagtgacattttggacaacctggagatcatcgacacttcgaactccgacttgaaccacatctttatcaacttttctgctgtctttgatgtgtctccagaggatgtcgaggctgcctttggtggcttcctagaaagattcggtaagagattcctaagactacgtgtctctgctgctgagattcgcatcattatccaggacccaaagactggtgcaccagtgccattgcgtgccctgatcaacaacgtctctggttatgtcgtgaagtctgagctatacaccgagatcaagaatgccaagggtgagtgggtctttaagtctctcggtaagccaggttctatgcatctgagaccaattgctactccatacccagttaaggagtggctacagccaaagcgttacaaggctcacctaatgggcacaacttacgtttacgatttcccagagctcttccaccaggctgctatcactacatggcagaagtacaagaccaactcttctcaaaaggatctaaccacaatgaaggagagagatgatctgtttatttcccacgagctgattgaggatgagagcggtgaactcactgaggttgagagagaacctggtgctaattcaattggtatggttgccttcaaggtcaccatgaagactcctgagtacccaagaggccgtcaatttgtcattgtcgctaacgatatcacctataagattggttcctttggtccacaagaggacgaattcttcaacaaggttaccgagtacgccagaaagagaggtattccaagaatctatctagctgctaactctggtgctagaatcggtattgctgaggagcttgttccactataccaggttgcctggaaggacgctgatgttccagcgaagggtttcgagtacatctacctgaacaaggatgaaatggagactctaaagggtcactccaaggagaactctgtcatcaccgagcgcatcgtcgaggacggtgaggagagatttgttatcaaggctattattggtgctgacgacggcctaggtgttgagtgtttgagaggttctggtttgattgctggtgcaacttcgagagcctaccaggacattttcactattactttggttacctgcagatccgttggtattggtgcttatctagtcagacttggccagagagctattcagattgagggtcagcctatcatcctaactggtgctcctgccatcaacaaggttctaggtagagaggtctactcctccaacctccaactcggtggtacacagatcatgtacaacaacggtgtttcccacttgactgcctctgacgatcttcaggcggttgagcagatcattaagtggttgtcctacgtccctgcaaagcgcaacatgccagttccaatcctagagaacggcgataagtgggacagacagattgactacagaccaactgttaatgagcagtatgatgttcgctggatgattgagggtcgcgaactagaagacggtaggtttgaatatggtatgttcgacaagggttctttctttgagactctgtcgggctgggctaagggtgtcgttgtcggccgtgcccgtctaggcggtattccaatcggtgttattggtgtggagaccaggaccatcgagaacgttatcccagcggaccctgccaacccagactctactgaggctgttgttcaggaagccggtcaagtgtggtaccccaactctgctttcaagactgctcaggccatcaaggactttaaccatggtgagcagctgccgctaatgattctagccaactggagaggtttctctggtggtcagcgcgacatgtacaacgaggttctgaagtacggttctttcattgtcgactccttagtggactacaagcagccaatcttcatctacattccaccaaccggtgagttgcgtggtggttcttgggtcgttgttgaccctactatcaacgccgaccagatggagatgtacgccgataaggactcccgtgctggtgttctagagccaagtggtatggttggtattaagtaccgtcgcgagaagctactggctacgatgaccagactcgacaccacttaccgcgaactaaaggagcagctatccgacaagacgctaacccctgctcaacaccaggaggtatctgtgaagcttgctgagcgtgagaagttcctactaccaatttacactcaggtaagtgttcagtttgctgatctgcatgaccgctcttctcgtatggtgaagaagggtgttatccgtgctgagctgacgtgggaggagtcccgtcgcttcttcttctggagactgagacgcaagcttgacgaggaatacctcgttaagcgtctggacattgagttgcctcacgcatcgcgtctggaaaagctggcgcgtctgcgttcatggtacccagcctctatcgatgagaccaaggaccgtgatgttgtgacatggattgaagagaactacaatgtgtttgaggaggagttcaaggccttgaagcttgagtcttttgcacaggagcttgccaagagcatgcgtactgatcacgatgttacgatgcgcggtctcgaggagattgcccgcatgttgtctaaggaggacaaggagaggctgctgagtgcgctaaagtaa

SEQ ID NO: 36 - DNA, 3690 bp, Artificial Sequence
  HPDH-MCRbs
atgaccgctggtaaaggtaaaggtgctaaagttgaccctgctggtggtaaagccgctactggtagattggccggtaaagttgcattggtcacaggtgcagctggtaatttgggtggtgccattattagaagattcattgccgaaggtgcaactttggttatgactggtagaactaaggaaagattagctgcagcaaagcaagctttattggacgaaactggtgttgaagaagcaagagtttttaccgtaatcttggatggtgctgatccagattcagttagagcaggtattgatcaagtcagagctgccttaggtagaattgatgttttggtcaataatgcaggttcagctggtcctagacaaacattggaaaacgtaccattgactagagccgaaatggaagcaaatggtgactcagaaacagtagctgacgccatgagaaatttgttgggtgtcagttggaacttaacaagagcagctgccccaataatgccagtaggtgcatcagtcgttaatatttccaccatcttctctcacacaagatactatggtagaacagcctatgtcgttcctaaggctgcattaaacgccttatcccaagaattagcaaaggaattaggtgcatctggtataagagtaaatacagttttcccaggtccaatcgaaagtgaaagaattagaacagttttcgcagctatggatgccttgcaaggtgaaccagaaaactctactgcaaatcatttcatgggtagaatgacattggaaagagctatcggtgacgcccctaaaagaaagactttgccagttccaggtgacattgcagatgcttgtttgtttttagcatcagatgaaagtgctgccttaaatggtaacgaaatagatgttacacatggtatgcaagttagaaaagatagtagatcaacttacatgactagaccatccatgagatctttggacggtgcaggtttgaccgtcttaattgccgctggtgaagcatgggaagatgcattagatatggctaagatccaagctgcatgtggtgccagagtcttattgggtatgactagacaagttgacgtcgcacaagccgaagccagagttaaagctcaaggtgctgaagaaggtttaaccatcatgagattcaacagagctgaacctgatggtatggaagcagccataagagcctattctgatgcacatggtgcaatccactctgccatcgttttacctgtaaagccagctggtcatttcggtgactctttggttgaagcttcagatgcagaagttgacgctttgattgatatcgaattaaccggtgctattgcagttgccagaaccttgagaagatactggaaaacatgctctgacttgatgcaagatccaagattcgtctttatgtcaggtccatctgatggtaaaggtaacaaagcaggtagaatattagcagccgcaatagcccaattaatcacaatttggagagatgaatctagagtagactttgcacaaggtagacaaaagagagccgcatggggtaatcaaatagttagatacacaaatgaagaagatgaaaacaccagattcgccgcaggtcatgctactagaattgttttcaaggaacaaaagataactgaaacttccttgtacttgcctgccaacattggtgaagaaactggtgctagaagagctatgttaggttttgccgaaaatatcactggtttgcatttgggtaaagtcgccatgattacaggtggttctgcaggtattggtggtcaagttgccagattattggcattggctggtgccaaagttatgatggtagctagaagagcaagtgaattggaagccgcaagagaaagaatagttggtgaattgcaagatgttggttttagtggtgttgaaagaagagttaaaatcatggcagatgttgacgtatccgactttgattctttaagaagagctgccgatgcaactatggcagaatttggtagaatagactacttgattaataacgctggtgttgcaggtgctgaagatatggttattgacatgtcattggatatgtggagatggacattggacgccaacttgatttcaaactatttgttaatgcactatgttgtcccaattatgaagagacaaggttccggttatatcttgaatgtttcttcctacttcggtggtgaaaagtttttggcagttgcctatccaaacagagctgattacgcagtctctaaagccggtcaaagagcaatggttgaatccttctcaagatttttgggtccagaaatccaagttaatgcaattgctcctggtcctgttgatggtgacagattgtcaggtactggtggtaaaccaggtttattcttgagaagagccagattaatcttggaaaacaaaagattgaatgcaatctatgctgcagttatcgaatcaataagagaaggtgcagaagttacacacgttttgggtagattagccagaaacgataccggttacttgtcacacgacagatccacccctgacccattgagattattatgtttggaattagccagagaaggtgacggtatttgcacatgggacagatacttattgacacctgatattgcaggtagattgttaatgagattggcctcagcaggttacttattggcacatgaagaatggcaacaaagaagtgcatcagcagaaggtagaactggttggttattggcattaccacctgacgatatgccatatttgcctcaagaaagaatcggtaaagaagcagataaagtcggtagaggtgttttgagtcaattacatttgggtgcaatgccaaaggaatcagaagttgcccaagcaacagtattttacttggctgatagagcagtttccggtgaaacattcatgccttctggtggtttgtccgtagaaagatcctacaccgaaagagaaatgtttggttcccctaaacaagaaagattggaacaaatgaagggtaaaacagtatgggtcatcggtgaacacttagccgattatatcgccgaaactgcaaatcacttaatcggtggtttaggtgttgcaagattggtcttattgacaagatctgaagccggtggtgcttcagttttggctttgttagaccctgaaatcgcagaaagagttaccgtcagattgtgtggtgcagatgtagaatcagctatggatcaagctttaacagacttcggtagacctaccacagtagttagtactcctatggcaggtttaccagacagattgtttgaagatggtgcaatgttagaaccagaagagtttagaactttgtgcgaagaaaatttgacacaacactttagagtttccagaaaggcatccttatatgatggttgccaattggttttagtatcaccagatgtcccatttggtcaatccggtcctgcctttgcattagccaacttcgtcaagacaactttgcatgctttcaccgcaactttagctgtagaaaacgaaagattagttcatgatgttcctaccaatcaaatcaacttgaccagaagagtaagaagtgaagaaccaagaaacgctgtagaacaccaagaagaattgaagagatttgctagagcagttttgttggttggtgcacctttgccagatgcccaagattccagatacagagcaagaatctacagaggtacaagtatgacagtttaa

SEQ ID NO: 37 - DNA, 3663 bp, Artificial Sequence
  HPDH-MCRca
atgagtggtacaggtagattggctggtaaaatagcattgataacaggtggtgcaggtaatataggttccgaattgacaagaagatttttggctgaaggtgcaactgttatcatatcaggtagaaatagagctaaattaactgctttggccgaaagaatgcaagcagaagcaggtgttccagctaaaagaatcgacttagaagtcatggacggttccgatcctgtagctgttagagctggtatagaagctattgttgcaagacacggtcaaatcgacatcttggtaaataatgctggttctgcaggtgctcaaagaagattggctgaaatccctttgactgaagcagaattgggtccaggtgctgaagaaaccttgcatgcttctattgcaaacttattgggtatgggttggcatttgatgagaatagctgcacctcatatgcctgtaggttctgccgtaattaacgtttccaccatattctcaagagcagaatactatggtagaatcccatatgttaccccaaaagcagccttgaatgcattgtcacaattggctgccagagaattgggtgccagaggtatcagagttaataccatctttccaggtcctattgaatccgatagaatcagaaccgtatttcaaagaatggaccaattgaagggtagacctgaaggtgacacagcacatcatttcttgaataccatgagattgtgtagagccaatgaccaaggtgcattagaaagaagatttccatcagtaggtgacgttgcagatgcagctgtatttttagcttcagctgaatctgccgcattgtctggtgaaaccatcgaagtaacacatggtatggaattgccagcttgttctgaaacatctttgttggcaagaacagatttgagaactatagatgcatctggtagaacaaccttaatatgtgctggtgaccaaattgaagaagttatggctttgactggtatgttaagaacttgtggttctgaagttattataggtttcagatccgctgcagctttggcacaattcgaacaagccgttaatgaatctagaagattggcaggtgctgattttacccctccaatcgctttaccattggacccaagagatcctgctacaattgatgcagtttttgattggggtgcaggtgaaaatactggtggtatccacgcagctgttatcttgcctgcaacctctcatgaaccagccccttgtgttatagaagttgatgacgaaagagtcttgaacttcttggctgatgaaatcacaggtactatcgtaatcgcttctagattggcaagatactggcaatctcaaagattgacaccaggtgccagagcaagaggtccaagagtaattttcttgtcaaacggtgctgatcaaaatggtaatgtatatggtagaatacaatcagctgcaataggtcaattgatcagagtttggagacacgaagctgaattggattatcaaagagcttctgctgcaggtgaccatgtattgcctccagtttgggctaatcaaatcgtaagattcgcaaatagatctttagaaggtttggaatttgcctgtgcttggaccgctcaattgttacattctcaaagacacatcaatgaaatcaccttgaatatccctgctaacatctcagcaaccacaggtgcaagatccgcttcagttggttgggccgaatctttaataggtttgcacttgggtaaagttgcattgatcacaggtggttctgctggtatcggtggtcaaatcggtagattattggcattgtcaggtgcaagagtaatgttagcagcaagagacagacacaagttagaacaaatgcaagccatgatacaaagtgagttagccgaagtaggttacactgacgtagaagatagagtccatatagcaccaggttgtgatgtctcctccgaagcccaattagccgatttggttgaaagaactttgtccgctttcggtacagttgattatttgattaataacgccggtatcgctggtgtagaagaaatggttatagatatgccagtcgaaggttggagacatacattattcgcaaatttgatctccaactacagtttgatgagaaagttggctcctttgatgaaaaagcaaggttctggttacatcttgaatgtttcttcatactttggtggtgaaaaagatgctgcaattccatatcctaacagagcagactacgccgtatcaaaggcaggtcaaagagctatggctgaagtttttgctagattcttaggtccagaaatccaaattaatgcaattgccccaggtcctgttgaaggtgacagattgagaggtactggtgaaagacctggtttgttcgctagaagagcaagattaatcttggaaaataagagattaaacgaattgcatgccgctttgatagcagccgctagaacagatgaaagatctatgcacgaattagtagaattgttgttgccaaatgacgttgcagccttggaacaaaacccagctgcacctactgctttaagagaattggcaagaagattcagatctgaaggtgacccagctgcttcttcttcttctgcattgttgaatagatcaattgcagccaagttattggctagattacataacggtggttatgtattgccagccgatatatttgctaatttgccaaacccaccagatccatttttcacaagagcacaaattgatagagaagccagaaaagttagagatggtataatgggcatgttgtacttgcaaagaatgccaactgaatttgatgttgctatggcaacagtctattacttagctgacagaaatgtttctggtgaaacttttcatccatcaggtggtttgagatatgaaagaactcctacaggtggtgaattattcggtttgccatcccctgaaagattagctgaattggtcggtagtaccgtatacttaattggtgaacatttgactgaacacttgaatttgttggccagagcttatttggaaagatacggtgcaagacaagttgtcatgattgttgaaaccgaaactggtgctgaaaccatgagaagattattgcatgatcacgtcgaagccggtagattgatgactattgtagctggtgaccaaatagaagctgcaatcgaccaagctattacaagatatggtagaccaggtcctgtagtttgtacaccttttagaccattacctaccgtccctttggtaggcagaaaagattctgactggtcaaccgttttatctgaagccgaatttgctgaattatgcgaacatcaattgactcatcacttcagagttgcaagaaagattgccttgtccgatggtgcaagtttagccttggtcaccccagaaactacagcaacttccaccactgaacaattcgcattggccaacttcatcaagacaaccttgcacgctttcacagcaaccatcggtgtcgaaagtgaaagaactgctcaaagaatcttaattaaccaagtagatttgacaagaagagctagagcagaagaaccaagagatccacatgaaagacaacaagaattagaaagattcattgaagctgttttattggtcacagcaccattgccacctgaagccgataccagatacgctggtagaatacatagaggtagagctataacagtttaa

SEQ ID NO: 38 - DNA, 3660 bp, Artificial Sequence
  HPDH-MCRcag
atgtccgtcacaggtagattggcaggtaaaatagccttgataacaggtggtgctggtaacataggttcagaaatgactagaagattcttagccgaaggtgcaactgttattatctcaggtagaaactcagctaaattggccgctttagcagaaagattgagatccgaagcaggtgttcctgctaagagaatagatttggaagttatggacggttcagatccagctgctgttagagcaggtgttgcagctatcattggtagacatggtcacatagatatcttagttaataatgcaggttccaccggtgcacaaagaagattggctgaaatcccattaaatgaaaccgatagagacttagacgatgaagaagctttgtctacaagtgttgcaaatttgttgggtatggcttggcacttaatgagaatcttaagtcctcatatgccaccaggttctgctattataaacatctccaccatcttcagtagagctgaatactatggtagaatcccttacgtcgttccaaaggcagccttgaatacattgactcaaatcgctgcaagagaattgggtatcagaggtatcagagttaacacaatctttccaggtccaattgaatccgaaagaatccaaacagtttttcaaagaatggaccaattgaaaggtagaccagaaggtgacacagcatcacaattcttggcaactatgagattatacagagctaacgatcaaggtcaattggaaagaagattcccaacaatctgtgacgttgctgatgctgcagttttcttggcctctgatgaagcagccgctttgacaggtgaaactatcgaagttacacatggtatggaattgccaacatcttcagaaacctctttattggctagaacagacttaagaactattgacgcaaatggtagaaccactttgatatgtgccggtgaccaaatcgaagaagttatggctttgactggtatgttgagaacttgtggttctgaagtcattatcggttttagaagtgaagctgcattggcacaattcgaacaagccatcggtgaatctagaagattggctggtgaatcctttatcccacctattgcattaccaattgacttgagaaacccaagtacaatagacgcattatttgattgggctggtgaaaatactggtggtattcatgcagccgtaatcttgccagcatcaggtagagaacctgcaacacaagttatagacatcgacgatgctcatgtccaagccttcttaaacgatgaaatcgtaggttccatcattatcgcatcaagattggctagatactggcaagcacaaagaatcgcacctggtgccagagcaagagaacctagagtcatcttcttgtctaatggtgcatcaactgctggtaatccttacggtagaatccaatccgcagctatagaacaattaataagagtttggagacatgaagcagccttggattacgaaagagcaaccgctgcaggtgaaagagttttgcctgcagtttgggcatcacaaatcgttagatttgcaaacagatccttagaaggtttggaatttgcctgtgcatggaccgcacaattattacattcccaaagaagaattaatgaaataacattaactatccctgccgacatctctgctactacaggtgctagaagtgccagtgttggttgggctgaaagtttgataggtttacatttgggtaaagttgccttgattactggtggttccgcaggtataggtggtcaaataggtagattattggctttgtccggtgcaagagttatgttagccgcaagagatcctcacaagttggaacaaattcaagccacaattagagcagaattagcagaagtcggttataccgatgtcgaagaaagagttcaaatcgctccaggttgcgacgtttcatccgaagaacaattagttgacttagttgaaagaacattagcagcctttggtacagttgactatttgatcaacaatgctggtatagctggtgtagaagaaatggttatcgacatgccagttgaaggttggagaaacacattgtatgccaatttgatctcaaactactccttgatgagaaaattggcacctttgatgaagaaacaaggttcaggttatgttttgaatgtttcaagttacttcggtggtgaaaaggacgcagcaatcccatacccaaacagagctgactatgctgtctcaaaagcaggtcaaagagcaatggcagaagttttcgctagatttttgggtccagaaatccaaattaatgctatagcacctggtccagtagaaggtgacagattaagaggtacaggtgaaagacctggtttatttgcaagaagagccagattgatcttggaaaacaaaagattaaacgaattacatgccgcattgatcacagcagcaagaacagataatagaccaatgagagaattggtagaattattattacctaacgatgttgcagcattggcacaacatcctgctgccccagatgttttgagaaccttggcaaagagatttcaatccgaaggtgaccctgctgcatcatcctcttctttcttattgaacagaagtatcgctgcaaaattgttggcaagattaattaatggtggttacgatttgccagcagatatcttcgctaacttggcagtcccacctgatccattctttacaagagcccaaatcgacagagaagccagaaaagtcagagatggtataatgggtatgttatatttgcaaagaatgccaacagaatttgacgttgcaatggctaccgtatactacttggcagacagaaatgtttccggtgaaaccttccatccttctggtggtttgagatacgaaagaacaccaacaggtggtgaattgttcggtttacctgctccagaaagattagccgaattggttggttccactgtctatttgatcggtgaacacttgactgaacacttaaacttattggcaagagcttacttggaaagatatggtgccagacaagttgttatgatcgtagaaaccgaagcaggtgccgaaaagatgagacacttattacatgatcatgttgaagcaggtagattaccaatcatagtagcaggtgaccaaattgaagctgcaatcgaccaagcaatagctaattatggtagacctggtccagttgtttgtactccattcagaccattaccttccgccccattagttggtagaaaggattcagactggtccaccgtattatcagaagctgaatttgcagaattgtgtgaacatcaattgactcatcattttagagtcgcaagaaagatagcattgtccgatggtgcatcattggccttagttacacctgaaactaccgcaacatcttcaacagaacaattcgccttagccaacttcgtcaagacaactttacatgccttcaccgccactatcggtgtcgaatcagaaagaactgcacaaagaattttgatcaatcaagtagacttaaccagaagagcaagagccgaagaaccaagagatccaagagaaagacaacaagaattggaaagattcatcgaagcagttttattagttactgctcctttaccacctgaagcagacactagatacgcaggtagaatacatagaggtagagccatcactgtttaa

SEQ ID NO: 39 - DNA, 3696 bp, Artificial Sequence
  HPDH-MCRct
atgagaagaacaaaaccagaatgcttgagaagaaatgaaagtacaatgagattgaacggtaaagtcgccttaataacaggtgccgcaggtggtatcggttcagtagtcacaagaatgtacttgagagaaggtgctagagttgcaatttcctcaagatccttggaaagagcagaacaattcagagcagccttaatggccgaaggtttttcaggtgacgatattttgccagtagcatttgccagtacagacttagccggtatgcaaacagctatcgaagcaattgcagctagatggggtggtttggatgttttaattaacaatgctggttcagctggtgcaaagcaacctttgttcagaatccctttcacctcagaagatttggctcaattggcagctgaaggtttcacagaaaccgaaacaatgagagaaagtgctgccaacttattgggtatgccttggcacttaacaagattggctttaccttacttgagagttggtgcttctattatcaatgtatctacaatcttctcaagaaccaattattatggtagaataccatacgtagtcccaaaatctgccttgaacgctttatccttgggtttggccaaacaattgggtaccactgacagagctgtcagagttaataccgtttttccaggtccaatagattcagacagaatcagaaccgttttcggtgctatggacagattgaaaggtgtcccagaaggtactaccgctcaagaatttttcgacattatgattttggctagagcaagaggtggtgaagcacctacaaagtgttatccaactcaagctgatgttgctcacgtaattttatttttgggttcagatgaatctgcagccatatctggtcataactttgaaataactcatggtatgcaagttaaggcacaatccagaacaaaattgactgcatggccagaccaaagattgatagatttgtcaagaagagttgtcttgattgttggtggtgaacaagtacatgatgctgtcacaatagcagcctcccaacaatcatatggtgcttcagttatcttgacattcagacaaccagaagcagttaatactgcaaaagctcaattggaatccagaggtttgaaccattctatagcagttacctggttagacccattgagaagagaatctgttacaagtgttttcgacttaatcagagaaagataccacagattggataccgttatagtttttccagctcatgccgctggtcattatggtcctgaattgatcccagatgaacctgaaagaatcagacaattcaccgatgaagctattttaggtacaaccgcattcgcagctcaattgtccagatttttattggctttcgatgcagaaaacgaattgcaagaacctgtcaacgttttgtttgtcacaaacgaacacgacggtgctacaaatgcatttgaagatatctatagagccgcagtcgaacaattgttgagagtttggagacacgaagatgaattgcaagttgcagctggtacaagaagattcgccgtaagaaccaaccaaatagtaagatatgctaatgcagaaccagacaacttgaagtttacagccgattggttggcaacattagccaacagagtcagaatctttgatgaattaaacttatacgtccctgaaaacatacaaagaaccaccggtaaaactgaattgccaagagatattgccagaactttattaggtttgcacataggtaaagttgcagtaataacaggtggttcagctggtataggtggtgctataggtcattacttagctttgtcaggtgcaaaagtagttttggctgcaagagatgctgaaagattggctgcattgaaaagagaaatcgttgcagaattatttgccgttggttaccctcaaccagaaaccagagttgaaaccttggctaatatagacgtagctgatgaagaagctttgggtagattagtaaaattcgctttggataaatttggtagaatagacttcttgataaataacgcaggtattgctggtgccgaagaaatggttgtagacttgccattggcagcttggagacatactttgaaagcaaatttgttaagtaattactccttgatatacaagatagcacctttgatgaaaaagcaaggtgcaggttatatcttgaatgtatcatcctacttcggtggtgaaaagtacgttgccgttgcatatccaaatagatccgattacgctgtttccaaagctggtcaaagagcattggctgaaatcttggctagacacttgggtcctgaaatccaaattaatgctttatccccaggtcctgttgaaggtaaaagattaagaggtgaaggttctagacctggtttatacgccagaagagcaagattgatcttggaaaataagagattgaatgacatccatgatgctgttatcagagcatggagagaaggtgaagctgttaaatccaccttgggtgcattggctcataatcatttcgaagatgttttagctgcaggtccaccagaacctgttagaagattaattacccatttgagagctgcagctgtcaacgaaggtcattcagattcccattacttgatgaccagaaaaatcgctgaaaagttgttgcacagattgttcgaaggtggttacttgacatcagtcgaagatagagaagcttttaccttagctttcttgagagaattaccagaacctccagatccatttttcgatccaaaagaaattgatagagaagctgaaagagttcaatctggtatcttgactatgttgaatttgagaagaatgcctacagaagaagaaatcgctatcgctacagttttctacttgtctgatcctaacatttctggtgaaaccttgcacccatcaggtggtttgaaattcgacagaacagtaaccgaaggtgaattttatggtttaccaagaaatgaacatttgatggaattaagaagaaagaatgtattgttaatcggtgactacttggaagaagaattgagatggttggtcggtgctttcgcaatccaattagttgtaagaaattgtatcattttgacaaagaccgccgaaagagctgatagtttgagacattacttttctgcacaaagattgaacaatttgcatatcttctctgctggtgcaaacgttgaagccgctatggatgacttgataagaagatttggtcacttggatgtcgtagtatccacaccttttgaccctttaccattgaaacctttggctgcaactgatgattggagaggtgtcttgaatgaaaaagacttcgaacaattggttgaaacacatattactcatcacttcagagtcgccaaaaaggctgccttgcaagataaatcccaaatcgtattagtaacccctaagacatcaagaaatagttccagagaagaatttgctttagcattgttcgttaaaacaaccttacatgcattgacagctaccttggcagttgaatgcgaaagattcacccatcatcctactgtaaatcaagttgatttgacaagaagagctagagtcgaagaaccaagaaacgaaagagaagaaagagaagaattggaaagattcgtagacgctgttttattggctgccgcaccagctcctgaaccagaacaatccagatacttgtccagaatacatagaggtaacgccatcactgtttaa

SEQ ID NO: 40 - DNA, 3651 bp, Artificial Sequence
  HPDH-MCRgb
atgaacgatatgtccgatattccacaagacttattaacacaaagtatagcaggtagaagattagataacaaatgtattattttaactggtgcagctggttcaatcggttcctttattacaagacaattattgagagaaggtgcaagagttatgttaacaggtagagatcaatcaaaattggacgactttattggtgacttggtatcagaaggtttcgaagaaactttcatggtttccgcaactggtgactgtgccgatcctgaagtctgtagagaaatagttgccaagacagttgccgcattcggtcctattgatgttttagtcaacaatgccggtgccgcaggtccaaaattcacattgagagatatccctttcaccgaagcagaacaaagagcagctgactcagatcaaacaatgtttgactcagccatgaatttgttgggtgctccttggaatatggccagagccgctgcaccacatatgtcagctggtgcctctataatcaacgttagtactatcttttctagaactcattactatggtagaataccttacgtcgttccaaagtctggtttgaacgcattgggtaaaggtttggcattagaattgggtgaaaaacaaggtatcagagtaaacactttatttccaggtcctattgaatccgaaagaattgaatcagttttcgccagaatggatgaattgcaaggtgttgaacctggttcaactggtaaagagtttagagatttgatgataactacaagaacctctgatggtggtttggaatataaatacccaactccaacagatgttgcatcaggtatcgtttggttggcatctgatgaatcctcagccttatctggtcatcacattgaagtcaccaatggtatgcaagtaccagcacaatctagatcccaattggtttcatggccagataagagattggaagatttgtcaggtcaagtcgttttgattttaggtggtgacgactatcaagaagcagttactttcgccgaaagacaaatccaatccggtgcaagagtaatgttagctttcagaaacttgaataccgttggtcatgctagatcattagttcaatcaagaaatttgggtgacgttcaattatcccacttggaccctttgagaagagaatcagttgacagatccatgcaattaatcgcagatcactttggtagattagatggtgtaatcttgttaccacaaaagccaaacggtgaatacggttattccttgactacagctaatgacgaagatgttgccaattttgttagagatgaagttgtcgcccctgttgcatttgcatccgctttcgcaagaaacatggatcaattgtttgccgaaggtgaaccaccagccatcgtttacgttactaaccctagtgatagacatggtaacttgatgaatgaaattatcagagcaagtgttgaagccttaatcagaggttggagacatgaagatgaaactttggcaaacactggtgaattgccttgggcagtacaaccaaaccaaatggttagatatgataccgaagatagagaagctttaactttcgcagccgactgggcagccactttaaccaacagagttagaaagatggatagtatcaacttatggttaccaagaagtattaaaagatccactggtaaaagtagtatgccaagtagtataagtagagtattgcctggtttgcacaagggtagaacagccgtaatcactggtggttccttaggtattggtttacaattgggtagatttttggcaatagctggtgccagagtcttgttatctgccagaagtgaaggtaaattggccgaagcaagagatgaaatcgttgacgaattgagaaacataggttatcctagaccagaatctagagttacaattttgggtggtatcgacgtaggtgaccctgatgcattggatagattacacgatcatgccgttgcagaattgggtcacgtagatttcttgattaataacgctggtatcagtggtgccgaagaaatggtagtcgatatgaccagagcagactgggatagaactatggaagccaacttgatctctaactactcattgattagaaaattctcacctgccatgaaagcaggtggtaaaggttccatattgaatgtttcctcatactttggtggtgaaaagtatgttgccgtagcatatccaaacagagctgattacgccgtatctaaggcaggtcaaagagtattagcagaaatattgtcaagacacttgggtcctgaaatccaaatcaacgctttagcacctggtccagttgatggtgccagattgagaggttcagccgaagcccctggtttattcgatagaagaggtagattagttttagaaaataagagattaaatgaagtccataaggctatcttggctggtatgagttcaggttttgatgctgacggtgttatgagtttggcatcaaacgctgttgattcaattgacatcgactccttacctaaaccagtcgccagattggtcttgaaaattagagattctggtggtatgggtaactcctcacactacttaatgcacatgggtatcgccgcaaaattgatgactagattagttagagcaggtatcttgtccgacgaacaaagagaacaatttttgggtacattcatagacgccccagcaccatttttcgatttctcagaaacttccaagcaagcagaacaaatcgaaacaggtattttgaacagattacacttgcataagatgcctacagatgaacaagtcggtttatccaccgtctttcacttggcagatgacattgtatctggtgaaacctttcatccatcaggtggtttgaaattcgacagatccgtcacagaaggtgaattgttgttacctccaaatgaaacagaagttgctaagttaaagggtaaaagaatcgttttgattggtgactcaatgagaaacgaattgactcatatagctaatggtttcttagcacaaaatgtagaaaaattgtgggttttgactaagacagaagattccgcaaacgctatgactcattcagtcgataaccctcatggtatcgacatagaatgtagagctattggtgacgacttagaaagttcattagatgacatcttgagaaacgatggtggttatgacgttgtagtttcatccccattcgaaagattgccattaaatgcattagctgccaacgctaatgaaccttgggatagagtcttatccgaccatgagtttagaaagttagttcacgaccaattgacccatcactttagagtcgcaagaaccagtgccttggttcctaattgccaaatcgttttaattactcctgacacttctttggcatcaactagagaagaatttgctttggccttattcgttaagaactcattgcacgcttttacagtcacattgggtgtagaaggtgaaagattgccaacagttccagcaattaatcaagtccaattgaccagaagagcacataccgaagaaccatccaacgaccaagaattggaagaagaaatgacaagattagtccatgccgtattacaatgctcagtccctgcaccagcaccatccgattcaagatacttgtccaaaatctttagaggtaacgctgtcaccgtataa

SEQ ID NO: 41 - DNA, 3666 bp, Artificial Sequence
  HPDH-MCRot
atgtttatgacaagattgaatgacaagattgctttgattactggtggtgctggtactataggtgaagttattacaagaagatatttggaagaaggtgcaacagtagttatggctggtagaaatagagacaaattagacagatatagagaaagattgataactgaatttcatgctttaccagaaagagttatggtagttagaatggacggttcatccaacgcagaagttagaatgggtattgccgctgttgtagcccactttggtagaattgatatattggtaaataacgcaggttcagctggtgccagacaaagattgccagctatcccattattgagatcagaattgcaagcagacgaaaccgaaactttggcagattcaatcggtaacttaataggtatcacatggaatttgattagagctgcagctccattcatgcctgcaggttcctcagttatcaatattagtacaatctttgctagaactgactactatggtagaatcccttatgttgtaccaaaggccgcattacacgccttaacattggcagccgcaactgaattaggtgaaagaggtataagagttaaccaaatcaacccaggtcctatcgactcagatagaattagaactgtttttagaagaatggatgaattgaagggtgttccagaacaatcaactgctgatggtttctttcaaatgatgagattgagaaggcctaatgccgaaggtgacttagttaagggttttcctaagactttggatgttgccaacgttgctgtatttttaggttccgcagaatcagctgcattgtccggtgaaacattggatgttacacacggtatggcagttccaacagaatcaagaacaactttgacaagtagacctggtttgagagcagtagacggtagtggtcacacaacattaatttgtgttggtgaccaaatcgaagaagcagcagccttaactggtgtattgagagcatgtggtgccgaagtagttatcggttttagatctagagccgcaatcgctagattcgaccacttgatcgaaagaggtagacacttaccatctcaagaacatgttgcccctgttttgttatatttgaatcctacagaaccagaatcaatagaccaagccttgagatggatggccactaacttagacttgcctacaagtgtaatcattttgcctgcacaaagacaaccattacctcctagtgttgttagagcctcagatgaagaagttgcatactttttaagagatgaattgagtggtatgatcgtcttggcaagtagattagcaagattctggcaacaagcaacattggcacctggtaatgcacctattcaaccaagagttttattcatgacaaacccagacgatggtcaaggtaacttatatgcagaaatattgagagcaggtgttgaacaattgtgtagagtttggagacacgaatcccaattggattatactagattggcccaaatggatgcacatccacctcatattagaccagtttgggcaaaccaattggttagatttgccaacaatgaacaagaaaatttggaatactgctgtgcttgggttgccaagatattgttatccgaaagaacaattgaagaattaaacttatacttgcctagacaaataggtagtacaacaggttccagacaaccttcctttggttgggcagaaaacttgataggtttgcacttgggtaaaacagcattgataactggtggttcagctggtataggttcccaaatcgcaagattgttagcattgtcaggtgcaagagttatgttgtgcgcaagagatgaaagaaaattaatccaaatgagagacatgataatcgcagaattgactgaagtcggttataaccaagttgaatctagagtacaaatttgtgccggttgtgacgttggtgaagaagaacaattggaaattgctgttcaaagaactttggacttatttggtcatgttgattacttaattaataacgcaggtattgccggtgctgaagaaatggttttagacttgcctttagaagcttggcaaagaactttaagaacaaatttgataagtaattattcattgatcagaaaattggctccacaaatgaaatcaagaggtagtggttatatcttgaatgtctcttcctacttcggtggtgaaaagtatgccgctattccttatcctaatagagctgattacgctgtatccaaagccggtcaaagagccttaggtgaagctttggctagattgttaggtccagaagttcaaatcaacgcaatggctccaggtcctgttgaaggtgaaagattgagaggttctggtgacagacctggtttatttttaagaagaggtagattaattttggaaaacaaaagattaaacgacttgcacgcaacattgattgctgcagaaagagaaacccaagttggtatgagagacttattagccagattgttacataacgatgtttgtgctttgattgatgaccctgcagccccaacacacttgagagctttggctgaaagaatctgggaacaatccgatccaaactcctatgctagagccttctttatgaatgccaatattgctactaagttattggccagattgttcaacgccgatcaaattgacgcccaaacattccacacatcccaacctaacttgccacctgaacctttcttcgctagaacccaaatagatagagaagctagaagagtcagagatggtgtaatgtccatgttgtacttacaaagaatgcctacagaatttgacgtagcattagccacagtttattacttgaacgacagatccgtttctggtgaaacattccatccaagtggtggtttaagacatgaaagaaccccaaccggtgccgaattgtatggtagtcctgcaccacaaagattggccagtttagccggttcaaccgtctatttgattggtgaatcaatggctgctcacttggaagctttagcaagagcttacattgaaagatacgcagctacaagagttgtcttgatctgtgctacacctgcaggtgttgaaagattcagtcatcacttagccgaccacttagcttctggtgctttggccatattatccgccgaagaaggtatcgaagcagctttgtcagaagccttgagaagattcggtcctccaggtccagttgttagtactcctttccaacctttgccatcacaacctttgattggtagaaacgactcagattggagtaccgttttagatgttgctggtttctccgcaatgtgtgaacaacaattaacccatcactttagagtcactagaaaattaagtttggtcgcaggtgtatcattggttttggtcactcctgaaacagattcacacagttccacagaacaattcgctttggctaactttgttaagactacattacacgctttcactgccacagttggtgttgaatgcgaaagaacagcacacagaattttggtcaatcaagttgatttgggtagacaagctagagcagaagaaccaagatcacctgcagaacaagcacaagaaatggaaagattcattgacgccataatgttaactaccgcacctattccagctgaagaagataacagatatactggtagaatatacagaggtagagccataacagtttga

SEQ ID NO: 42 - DNA, 3690 bp, Artificial Sequence
  HPDH-MCRrc
atgtctacagtcagaagattggaaggtaaagttgcattgataacaggtggtgccggtaatataggtgaagtaataacaagaagatttttggcagaaggtgctaccgttgttatcacaggtagaaatgccgaaaaattggctgtctacagaagaagattaattgacgaagaaagagtagcaccagaaagagtcgttgctttgagaatggatggttctgacattgcccaagttagagctggtgttgctcaaattgttcacggtggtacagatgtcccaatcccattgcatagaatagatatcttggtcaacaatgcaggttctgcaggtccaagaagaagattagttgatatccctttggaaccatccgaagttcaacctccagattcagaaactttggcacaagctgttggtaatttggttggtataacatggaatttgacaagagcagccgcaccacacatgccatccggttcatctgttattaacatctctacaatcttctcaagaaccgattactacggtagaatagcctatgtagcacctaaggctgctttgaacgcattatctgacggtttggccagagaattgggtgttagaggtatcagagtcaataccatatatcctggtccaatcgaatcagaaagaatctacactatgtttcaagctatggacgctttaaagggtcaaccagaaggtgacacagctagtggtttcttaagaatgatgagattgtctagaatcgaccaaaacggtgaagttgttaagagattcccaagtcctgtagatgttgcaaatactgctgtattcttggcatctgacgaaagtgcagcttttacaggtcatgcctttgaagtcacacacggtatggaagttccaaccgaaagtagaaccactttcgtttccagaccaggtttaagatccgttgatgcaaccggtaaagttattttaatatgtgccggtgaccaagttgatgacgctgtcgcattggctgatacattgagatcatgtagagctaccgttgtcatcggtttcagagatccaagagcattagaaaaggcatccgttttgttgagagaacctagacacgctttggcagctgacatgtacggtagacctacaatgactgcagaagctagattggtcagattagatcctttagacccaagagcagctgcccaaactttggaacaaatacatgccgaattgggtgccatccaccatgctgtcgtattgcctggtcaatctagacatgcaccttcagcttccttgatcgaagttgatgaccaagttgttgaaagattcttacaccaagaattagttggtactattgccttagcaagagaattggccagattttgggaagaatatccatccggttcttcaatgcatagagttttatttgtttccaatcctgacgatcaacaaggtaaccaatacagtcacatcttgagagctgcagttgaacaattagtcagagtatggagacacgaatccgaatatgactccgttaaccctgcacaccaacaagaaggtcaatcctcagcagctgtttgggctaaccaattaataagatatgttaataacgaaatggctaacttggacttcacttgcgcctgggttgccaagttattaggttccgatagaagaatcgccgaaattaacttatacttgcctgaagaaatcgttggtacaataggtgtccacaatcctggttttggttgggctgaatccttatttggtttacacatgggtaaagtcgcattaataacaggtggttccgccggtatcggtggtcaaattggtagattgttagcattaagtggtgctcatgttatgttagcagctagaaatgcagatcaattagaacaaatgagagcttccatagttagagaagttagagatgcaagttatcctgacgcagaatcaagagttgccatcttccctggttcagacgtttcagatatcgacggtttggaaagattggtaaatcatacagtaagagtttttggtaaagttgactatttgatcaacaatgctggtatagcaggtgcagaagaaatggttatagacatgccagttgatgcatggagacacacattgagagccaacttaatctccaattatgcattattaagaagattagcaccacaaatgaaggcagccggtggtgcatacgtattgaacgtatcatcctattttggtggtgaaaaatacgttgccataccataccctaatagatccgactacgcagtttccaaagctggtcaaagagcaatggttgaatccttggcaagatttttgggtccagaaatacaaatcaacgcaatagctcctggtccagttgaaggtgaaagattgaaaggtgctggttcaagacctggtttattcatgagaagagccagattgatcttagaaaataagagattgaatgaagttttcgccgctttattggccgcaagacatgaaggtgccacaatagccgacttgttacctgacttgttcgccaatgatatccaatcaatagcaaattccgcagccatgccagcacctttgagaagattagccacaatgttgagagaaacatctgacgcaggtggtagtgcccaatcatatttgatgaacgctactatcgcaagaaaattattgaacagattggaaaacggtggttatatcaccttacacgatagaagagccttgactgttgaaccacctgaacctttcttcacagaagcacaaatcgaaagagaagccatcaaagttagagatggtatcttgggtatgttacacttacaaagaatgccaaccgaatttgatgtagcattagcaaccgttttctacttggccgatagaaatgtcacaggtgaaacttttcatccatcaggtggtttgagatttgaaagaacagttaccgaaggtgaattgttcggtaaaccaggtcaacaaagattagaaagattgaagggttctgtagtttacttaatcggtgaacatttgagacaacacttggttttattggccagaacctttttggatgaaatacatgtagccagagttgttttattgaccgaaaccacacaagcagctactgacttagcagccgaattgtctgactatgaagctgcaggtagatttgtcgtaatcccaacttgcggtgacatagaaggtggtattgacagagcaatggcagaatatggtagacctggtccagtcatctcaacacctttcagacctttaccagatagagctttatcagctagaaatggtgactggtcctcagttttaactacagctgaatttgaagaattggttgaacaacaaatcacacatcacttcagagttgcaagaaaagcaggtttgatcgaaggtgctaacgttaccttagtcaccccacctacttcagcaagatctacatccgaagaatttgccttggctaattttgtaaaaacaacattacatgcattgaccgccacagctggtgcagaatccgaaagaacagttccacatgtcccagtaaatcaagttgatttgaccagaagagctagatccgaagaaccaagaaccccttccgaagaagaagaagaattgcaaagatttgtcaatgccgttttgttaacctccgctcctttaccaacacctttggaatcaagatatagagccagaatctacagaggtaatgctatcacagtttaa

SEQ ID NO: 43 - DNA, 3615 bp, Artificial Sequence
  HPDH-MCRsl
atgaatgcaatgggtaaaacagaaacacaaggtagattagctggtaaagtagccttgataactggtgccgccggtaacttaggtggttctatcgtaagaagatatttggccgaaggtgcaacagttgtcatgtccggtagagatgctgccagaactcaagcagctttagatgcagcagtagctgacgttggtggtactgcttcaattgtcactatggatggtgcaaatatcgaatccgttagagcaggtatcgcagatgttgtcgcaagacatggtagaatagacgtcttggttaataacgcaggttcagctggtccaaagcaagttttgggtgacttacctttgttgccagaagaattggaaggtacacctgattcagaaacagttggtgacgcagcaagaaatataatggttgtcgcatggaacttagttagagctgccgcatctgctatgggtgaaggtggttccatcattaatgtttccacaatattctcaagaactgattattttggtagagcagcttatacagttccaaaagctgcattgaatatcttatccaaaggtatcgcaagagaattgggtaccagaggtatcagagtcaatcaattgtatcctggtccaatcgcctcagaaagaatcagaacagttttcgccgcaatggataagttgaaaggtgacgatgccggttcaactgccaaccatttctttaatttgatggctttggaaagaagtgtaggtgaagatgccaaagcaaagaccttccctacaccagctgatatcgcaaacacttgcgttttcttgggttcagacgaatccgctgcctttgcagcacacgactttgaagttacacatggtatggcagtacctttggaatcaaaatccgaatttttgcatagacctgacttgagagcaatagatggtgacggtcatggtatcttgatttcagccggtaaccaattagacgatgcattggctatggcaggtttgttcgcagcacaaggttcaaaagtcttgttgggttttcacgcacaagctgcattggacgatgcagcagaaagattgccagccggtgtcaaagcagttagatttccaagacatgaccatatggcaatggacgctgaattggccagattcacagcacatgtagccgcaattgacggtgctattatattgccaacaagaggtccaggttactttcatggtgcattgaacgaagcttccgacgctgccgttgaaagatttgtcgatgacgaattggaaggtgcaattgctgttgcaagaacattagatagatattggcaacaaggtcaagacttgcctggtgaccctagagtcttgtttatcacaaaccctgatgatggtgcaggtaatggttgggcagatgttggtagagcagcaatcgaagaattgttgagagtttggagagatgaagctagagtagccgcaacacaaggtaaaactcctagacctgtttggggtaaccaaattgttagatttggtaataacgaaccagaaaatagagactttgctgcaggtcatgccgcaagattgttattaggtggtagacaaatagaaccaatcaatttgtacatccctgcatctatcacaaaagccactggtgccagaagagccttagcaggtaccgcagaaaatatcacaggtttgcatttgggtaaagtagccttgattacaggtggttccgcaggtataggtggtgccttagccagattgttagccttggcaggtgcaaaagttatgatggtcgctagaagagaatctgaattagatgctgctagagaaagaatcgttggtgaattgcaagacatcggtttcgcaggtgtcgaaagaagagttttgaccttggctggtattgatgttgctgacatgaaatcattaaagcacgctgttgatgaaacagtcagagcattcggtagaatcgactacttaattaataacgccggtgtatcaggtgcagaagaaatggctgttgatatgggtgttgaaaacttcagacatacacaatttgcaaatttgatctcaaactacgctttaatgcacatggttgtcccaatgatgagaaaacaaggttccggttatatcttgaatgttagttcttactttggtggtgaaaagtatttggctgtctcctatccaaatagaacagactacgcagtatcaaagtccggtcaaagagcaatggttgaaagtatggcaagacacttaggtcctgaaattcaaatcaatgccatagctccaggtccagtagatggtgacagattagctggtttgggtggtaaaccaggtttgtttgaaagaagaggtagattgattttagaaaacaagagattgaacgctgttcactcagctgttatcaagtccgtcagagcaggtggttctgttgcccaaattttattcagattgtccagaaatgactcagttcaattgtcccacgataagtcaaacccacaacctttaagagatttggccttggcatgtgcaagagaaggtgacgaatcatgctgctgggacagattcatcttgacacctgtattggccgcaaagttgttgaaaagattaagattgggtggttggttgataggtaccgactggcaatccagagatgaatccgattggttgttaagagtccctccagacgacatgccttggttgccagttgcacaaattggtagagaagcagccaaagttagaggtggtgtattgtcccaattacatttgggtaaaatgcctaccgaaacagaagttgctcaagcaactgttttctttttagctgatagagcagtctcaggtgaaactttcatgccttcaggtggtttaaatgtcgaaagatccgccaccgaaagagaattgtttggttcccctaaggcagaaagattggcacaaatgggtggtaaaacagtttggttggtcggtgaacatttggcagactacttgggtgctgcagctcaaggtttcttgaattgtgacgttgctagagtagttttaatcactgcctcagctgcaggtgctacagccattaagggtcatattggttccggtgctgacagagtagaaagtttattgatagacggtgaaatcgaaacagccttagatgcagctttggctacttggggtcatcctactacaatcgtttccactccattgaaagcattgccagaccaattgtttgatgcagataatccattagatggtgacggttttgctgatgtcgttgaacataatttgactcatcactttagaattgccagaaaagtcagtttatttgacgaatgccaattggtattagtttcaccagatgttcctatgggtgaaggtgcaaaaggtgcatttgccttggccaactttgtcaaaaccacattacacgcttttactgcaactatcgcagttgaaaatgaaagattggtccacgaagtcgccgttaatcaaatcaacttgacaagaagagtaagatcagaagaacctaaaaacgcagctgaacatgaagaagaagttagaagatttgcaagagccgttttattggctggtgcaccattacctgacgcagaagatagtagatatagatccagaatctacagaggtatgtccttaaccgtataa

SEQ ID NO: 44 - DNA, 3663 bp, Artificial Sequence
  HPDH-MCRca_variant_3
atgagtggtacaggtagattggctggtaaaatagcattgataacaggtggtgcaggtaatataggttccgaattgacaagaagatttttggctgaaggtgcaactgttatcatatcaggtagaaatagagctaaattaactgctttggccgaaagaatgcaagcagaagcaggtgttccagctaaaagaatcgacttagaagtcatggacggttccgatcctgtagctgttagagctggtatagaagctattgttgcaagacacggtcaaatcgacatcttggtaaataatgctggttctgcaggtgctcaaagaagattggctgaaatccctttgactgaagcagaattgggtccaggtgctgaagaaaccttgcatgcttctattgcaaacttattgggtatgggttggcatttgatgagaatagctgcacctcatatgcctgtaggttctgccgtaattaacgtttccaccatattctcaagagcagaatactatggtagaatcccatatgttaccccaaaagcagccttgaatgcattgtcacaattggctgccagagaattgggtgccagaggtatcagagttaataccatctttccaggtcctattgaatccgatagaatcagaaccgtatttcaaagaatggaccaattgaagggtagacctgaaggtgacacagcacatcatttcttgaataccatgagattgtgtagagccaatgaccaaggtgcattagaaagaagatttccatcagtaggtgacgttgcagatgcagctgtatttttagcttcagctgaatctgccgcattgtctggtgaaaccatcgaagtaacacatggtatggaattgccagcttgttctgaaacatctttgttggcaagaacagatttgagaactatagatgcatctggtagaacaaccttaatatgtgctggtgaccaaattgaagaagttatggctttgactggtatgttaagaacttgtggttctgaagttattataggtttcagatccgctgcagctttggcacaattcgaacaagccgttaatgaatctagaagattggcaggtgctgattttacccctccaatcgctttaccattggacccaagagatcctgctacaattgatgcagtttttgattggggtgcaggtgaaaatactggtggtatccacgcagctgttatcttgcctgcaacctctcatgaaccagccccttgtgttatagaagttgatgacgaaagagtcttgaacttcttggctgatgaaatcacaggtactatcgtaatcgcttctagattggcaagatactggcaatctcaaagattgacaccaggtgccagagcaagaggtccaagagtaattttcttgtcaaacggtgctgatcaaaatggtaatgtatatggtagaatacaatcagctgcaataggtcaattgatcagagtttggagacacgaagctgaattggattatcaaagagcttctgctgcaggtgaccatgtattgcctccagtttgggctaatcaaatcgtaagattcgcaaatagatctttagaaggtttggaatttgcctgtgcttggaccgctcaattgttacattctcaaagacacatcaatgaaatcaccttgaatatccctgctaacatctcagcaaccacaggtgcaagatccgcttcagttggttgggccgaatctttaataggtttgcacttgggtaaagttgcattgatcacaggtggttctgctggtatcggtggtcaaatcggtagattattggcattgtcaggtgcaagagtaatgttagcagatattcaagaagataagttagaacaaatgcaagccatgatacaaagtgagttagccgaagtaggttacactgacgtagaagatagagtccatatagcaccaggttgtgatgtctcctccgaagcccaattagccgatttggttgaaagaactttgtccgctttcggtacagttgattatttgattaataacgccggtatcgctggtgtagaagaaatggttatagatatgccagtcgaaggttggagacatacattattcgcaaatttgatctccaactacagtttgatgagaaagttggctcctttgatgaaaaagcaaggttctggttacatcttgaatgtttcttcatactttggtggtgaaaaagatgctgcaattccatatcctaacagagcagactacgccgtatcaaaggcaggtcaaagagctatggctgaagtttttgctagattcttaggtccagaaatccaaattaatgcaattgccccaggtcctgttgaaggtgacagattgagaggtactggtgaaagacctggtttgttcgctagaagagcaagattaatcttggaaaataagagattaaacgaattgcatgccgctttgatagcagccgctagaacagatgaaagatctatgcacgaattagtagaattgttgttgccaaatgacgttgcagccttggaacaaaacccagctgcacctactgctttaagagaattggcaagaagattcagatctgaaggtgacccagctgcttcttcttcttctgcattgttgaatagatcaattgcagccaagttattggctagattacataacggtggttatgtattgccagccgatatatttgctaatttgccaaacccaccagatccatttttcacaagagcacaaattgatagagaagccagaaaagttagagatggtataatgggcatgttgtacttgcaaagaatgccaactgaatttgatgttgctatggcaacagtctattacttagctgacagaaatgtttctggtgaaacttttcatccatcaggtggtttgagatatgaaagaactcctacaggtggtgaattattcggtttgccatcccctgaaagattagctgaattggtcggtagtaccgtatacttaattggtgaacatttgactgaacacttgaatttgttggccagagcttatttggaaagatacggtgcaagacaagttgtcatgattgttgaaaccgaaactggtgctgaaaccatgagaagattattgcatgatcacgtcgaagccggtagattgatgactattgtagctggtgaccaaatagaagctgcaatcgaccaagctattacaagatatggtagaccaggtcctgtagtttgtacaccttttagaccattacctaccgtccctttggtaggcagaaaagattctgactggtcaaccgttttatctgaagccgaatttgctgaattatgcgaacatcaattgactcatcacttcagagttgcaagaaagattgccttgtccgatggtgcaagtttagccttggtcaccccagaaactacagcaacttccaccactgaacaattcgcattggccaacttcatcaagacaaccttgcacgctttcacagcaaccatcggtgtcgaaagtgaaagaactgctcaaagaatcttaattaaccaagtagatttgacaagaagagctagagcagaagaaccaagagatccacatgaaagacaacaagaattagaaagattcattgaagctgttttattggtcacagcaccattgccacctgaagccgataccagatacgctggtagaatacatagaggtagagctataacagtttaa

SEQ ID NO: 45 - DNA, 3663 bp, Artificial Sequence
  HPDH-MCRca_variant_6
atgagtggtacaggtagattggctggtaaaatagcattgataacaggtggtgcaggtaatataggttccgaattgacaagaagatttttggctgaaggtgcaactgttatcatatcaggtagaaatagagctaaattaactgctttggccgaaagaatgcaagcagaagcaggtgttccagctaaaagaatcgacttagaagtcatggacggttccgatcctgtagctgttagagctggtatagaagctattgttgcaagacacggtcaaatcgacatcttggtaaataatgctggttctgcaggtgctcaaagaagattggctgaaatccctttgactgaagcagaattgggtccaggtgctgaagaaaccttgcatgcttctattgcaaacttattgggtatgggttggcatttgatgagaatagctgcacctcatatgcctgtaggttctgccgtaattaacgtttccaccatattctcaagagcagaatactatggtagaatcccatatgttaccccaaaagcagccttgaatgcattgtcacaattggctgccagagaattgggtgccagaggtatcagagttaataccatctttccaggtcctattgaatccgatagaatcagaaccgtatttcaaagaatggaccaattgaagggtagacctgaaggtgacacagcacatcatttcttgaataccatgagattgtgtagagccaatgaccaaggtgcattagaaagaagatttccatcagtaggtgacgttgcagatgcagctgtatttttagcttcagctgaatctgccgcattgtctggtgaaaccatcgaagtaacacatggtatggaattgccagcttgttctgaaacatctttgttggcaagaacagatttgagaactatagatgcatctggtagaacaaccttaatatgtgctggtgaccaaattgaagaagttatggctttgactggtatgttaagaacttgtggttctgaagttattataggtttcagatccgctgcagctttggcacaattcgaacaagccgttaatgaatctagaagattggcaggtgctgattttacccctccaatcgctttaccattggacccaagagatcctgctacaattgatgcagtttttgattggggtgcaggtgaaaatactggtggtatccacgcagctgttatcttgcctgcaacctctcatgaaccagccccttgtgttatagaagttgatgacgaaagagtcttgaacttcttggctgatgaaatcacaggtactatcgtaatcgcttctagattggcaagatactggcaatctcaaagattgacaccaggtgccagagcaagaggtccaagagtaattttcttgtcaaacggtgctgatcaaaatggtaatgtatatggtagaatacaatcagctgcaataggtcaattgatcagagtttggagacacgaagctgaattggattatcaaagagcttctgctgcaggtgaccatgtattgcctccagtttgggctaatcaaatcgtaagattcgcaaatagatctttagaaggtttggaatttgcctgtgcttggaccgctcaattgttacattctcaaagacacatcaatgaaatcaccttgaatatccctgctaacatctcagcaaccacaggtgcaagatccgcttcagttggttgggccgaatctttaataggtttgcacttgggtaaagttgcattgatcacaggtggttctgctggtatcggtggtcaaatcggtagattattggcattgtcaggtgcaagagtaatgttagcagatgttgatactagaaagttagaacaaatgcaagccatgatacaaagtgagttagccgaagtaggttacactgacgtagaagatagagtccatatagcaccaggttgtgatgtctcctccgaagcccaattagccgatttggttgaaagaactttgtccgctttcggtacagttgattatttgattaataacgccggtatcgctggtgtagaagaaatggttatagatatgccagtcgaaggttggagacatacattattcgcaaatttgatctccaactacagtttgatgagaaagttggctcctttgatgaaaaagcaaggttctggttacatcttgaatgtttcttcatactttggtggtgaaaaagatgctgcaattccatatcctaacagagcagactacgccgtatcaaaggcaggtcaaagagctatggctgaagtttttgctagattcttaggtccagaaatccaaattaatgcaattgccccaggtcctgttgaaggtgacagattgagaggtactggtgaaagaggtggtttgttcggtagaagagcaagattaatcttggaaaataagagattaaacgaattgcatgccgctttgatagcagccgctagaacagatgaaagatctatgcacgaattagtagaattgttgttgccaaatgacgttgcagccttggaacaaaacccagctgcacctactgctttaagagaattggcaagaagattcagatctgaaggtgacccagctgcttcttcttcttctgcattgttgaatagatcaattgcagccaagttattggctagattacataacggtggttatgtattgccagccgatatatttgctaatttgccaaacccaccagatccatttttcacaagagcacaaattgatagagaagccagaaaagttagagatggtataatgggcatgttgtacttgcaaagaatgccaactgaatttgatgttgctatggcaacagtctattacttagctgacagaaatgtttctggtgaaacttttcatccatcaggtggtttgagatatgaaagaactcctacaggtggtgaattattcggtttgccatcccctgaaagattagctgaattggtcggtagtaccgtatacttaattggtgaacatttgactgaacacttgaatttgttggccagagcttatttggaaagatacggtgcaagacaagttgtcatgattgttgaaaccgaaactggtgctgaaaccatgagaagattattgcatgatcacgtcgaagccggtagattgatgactattgtagctggtgaccaaatagaagctgcaatcgaccaagctattacaagatatggtagaccaggtcctgtagtttgtacaccttttagaccattacctaccgtccctttggtaggcagaaaagattctgactggtcaaccgttttatctgaagccgaatttgctgaattatgcgaacatcaattgactcatcacttcagagttgcaagaaagattgccttgtccgatggtgcaagtttagccttggtcaccccagaaactacagcaacttccaccactgaacaattcgcattggccaacttcatcaagacaaccttgcacgctttcacagcaaccatcggtgtcgaaagtgaaagaactgctcaaagaatcttaattaaccaagtagatttgacaagaagagctagagcagaagaaccaagagatccacatgaaagacaacaagaattagaaagattcattgaagctgttttattggtcacagcaccattgccacctgaagccgataccagatacgctggtagaatacatagaggtagagctataacagtttaa

SEQ ID NO: 46 - DNA, 777 bp, Artificial Sequence
  BDHcm
atggtcaacttacaaggtaaaacagcattggtcactggttcaacatcaggtatcggtttgggtatcgcagaagcattgggtagagccggtgctaatatagtattaaacggttttggtgacgttgatgctgcattggcaacaatcgccgctaccggtgcacaatctgcccatcacccagctgatatgagaaaacctgacgaaattgaagcaatgatagctatggcaagagaaagattcggtaccgttgatgtcttagtaaataacgctggtattcaacatgttgcacaagtcgaagattttccagcacaaaagtgggatgacatcttggccataaatttgacttcttcattccatactacaagacacgttatacctgctatgagagcaagaaattggggtagaatcgttaacattgcttcagtacatggtttagttggttccgccggtaaaagtgcttatgttgcagccaagcacggtttagtcggtttgaccaaagtaactgcattggaaacagccggtaccggtatcacttgtaatgctatttgcccaggttttgttttaacacctttggtcgctgcacaaatagatgctattgctaaaagagatggtatttctatggaagccgctagagctagattgttatctgataagcaaccatcaggtcaatttgtcactcctgaacaattgggtaacttggttttaatgttgtgtagtccattcggtgaccaagttagaggtgcagcctgggctatggatggtggttggacagctcaatga

SEQ ID NO: 47 - DNA, 771 bp, Artificial Sequence
  BDHkp
atgaatttgcatggtaaaacagcattagtaactggttctacatcaggtatcggtttaggtatcgccaaggtcttagcacaagcaggtgcacaattggtattaaatggttttggtgactcttctcatgctagagcagaagttgctgcattgggtaaaataccaggttatcacgatgctgacttaagagatgttggtcaaattgaagctatgatgcattacgcagaatccaccttcggtggtgtagatatcgttattaataacgccggtattcaacacgtcgctccagtagaacaatttcctgtcgataagtggaatgacatattggctatcaacttatccagtgttttccatactacaagattggcattacctggtatgagacaaagaaactggggtagaattataaacattgcatctgttcacggtttggtcgcatctaaagaaaagtcagcctatgttgccgctaaacatgccgttgtcggtttgaccaagactgtcgcattagaaacagccagatcaggtatcacctgtaatgctatttgcccaggttgggtattgactcctttagttcaacaacaaattgataagagaatagccgaaggtgttgacccagaacaagcctccgctcaattgttagctgaaaagcaaccaagtggtgaatttgttacacctcaacaattaggtgaaatggcattgttcttatgttctgatgcagccgctcaagtcagaggtgcagcctggaacatggacggtggttgggtagctcaatga

SEQ ID NO: 48 - DNA, 1113 bp, Artificial Sequence
  HBDHos
atgcaattattcaagttaaagaccagattatcaaagttcgatcatttcgcagatttcgccagagagtttaagttatcagaacatgacttggttatcactaacgaatttttgtacgaacctttcatgaagtcattaaacttgccatgtcatttcattatgcaagaaaaatttggtttaggtgaaccatcagacaagatgatgaacacaattttgaaagaagttaagggtgttggtttcgatagagtaatagctgttggtggtggtactgttatcgacatttcaaaattgttcgttttaaagggtgttgaagatgtcacagaagcattcgaaagaaaaattccaatcgtaaaagaaaagcaattagttatcttgcctacaacttgtggtactggttcagaagttacaaatatctcaatagcagaaatcacatcaaagcataccaagatgggtttggcagacgatgccatcgttgcagatgacgctgtattggttccagaattgttaaaaggtttaccttttaagttttatgcctgttctgctattgacgcattggttcatgctaccgaatcatatgtttctccaaaatcaaatccatacactagattatattgtagagctgccattgaaataatcattgatgtttttcaaggtatcgctgcaaacggtccagaatacagatttgaaagattgggtgacatgttaatggctagtaactacgctggtatagcttttggtaacactggtgttggtgcagttcatgccttgtcatacccattaggtggttcctaccatgttccacatggtgaatccaactaccaattctttacagaagtttttaagttatataatgccaagaacccatcaggtgacatagctagattgaatgacttgttatgtgtacaattgggtgttaatgaaaacccttacccagttttagacgaattgttgggtaaattgattcctaaaaacaaattgagagtctacggtatgaagccagaagaaattcaaggtttcacatcctcagttttacaaacccaacaaagattgttagcaaacaactatgtatccttatccgaagaagaaatcagagaaatctacaaagtattatattga

SEQ ID NO: 49 - DNA, 1137 bp, Artificial Sequence
  HBDHps
atggccttcatctattacgtcacacaaatccaatttgaatttggtgccgtcaagttattaaagcaagaatgcgaaagagtaggtatcactagaccattgattgtcacagatcctggtgtaaaagctgcaggtatattacaaaaggctttagatgcattgccaggtatcgctgtaactgtttttgaccaaacaccatcaaatcctaccgaagccgctgttagagcagccgctgcattgtataaagcaggtggttgtgatggtttaattgctgttggtggtggttccgcaatagactgcgccaagggtgttgctatcgccgctacacatgaaggtcctttgactacatacgctaccatagaaggtggttcaccaaaaatctccgatagagttgcaccattaattgccgtccctaccacttctggtacaggttctgaagtagccagaggtgctataatcatcgttgatgaccatagaaagttgggttttcattcatggcacttagttccaaagaccgcaatttgtgatcctgaattgactttaggtttgccagctatgttgacagcagccaccggtatggacgccattgctcattgcatggaaacctttatgtctccagctttcaatccacctgcagatggtattggtttagacggtttggaaagaggttggtcacacatagaaagagctactagagatggttccgacagagaagcaagattaaacttgatgtctgcttcaatgcaaggtgcaatggccttccaaaaaggtttaggttgtgtccattccttaagtcactctttgggtggtgtagatcctagattacatcacggtacattgaatgccatgtttttaccagctgttgtcagattcaacgctagtgcagaatctgttcaaaaggaaagaagattggatagaatggccagagctatgggtttaagatcaggttccgatatccctgacgcaattaaggatatgaatgccagattaggtttgccaactggtttggctgcaatgggtgttcaaagagattggttcgacagaattatagtcggtgcattggccgatcattgccacaagactaacccaagattagctagtcctgaagaatatagagaaatgttagaaacatctttgtga

SEQ ID NO: 50 - DNA, 867 bp, Artificial Sequence
  HIBADHas
atgcaaactatcggtttcatcggtttaggtgttatgggtaaatctatggcaagacacttattgagagcaggttattcattggtcgtttataccagaactaagcaaaaggcagaagatatattggctgaaggtgcattgtggaaagaaactgtaaaggatgttgctaaagctgcagacgttgtcatgacaatggttggtgaaccacaagatgtcgaatatgtatactttggtgacgatggtatcttggctcatgcaaagagaggtacatacgtcattgatttcactacatccaaaccaagtttagctgtaagaatacacgaagccgctaaagaaaagggtatctttgttttggatgcacctgtctctggtggtgacattggtgctagagatggtaccttatcaataatggttggtggtgacaaggaagccttctctgcttgtatgccattgttgtcacatttgggtaaaaatatagtctggcaaggtgaagccggtgctggtcaacacacaaagatgtgtaatcaaattgcaatagccaccaacatgataggtgtatgcgaagcattagtttatgcagaaaaagccggtttagatcctgaaagagttttgagatccattagtcaaggtgcagcctcttcatggtctttatcaaacttggctccaagaatgttggctggtgactttgcacctggtttctacgttaagcatttcatcaaggacatgggtattgctttagcagaagccgaaaccttgggtttatccttgcctggtttaaaattggccaagcaattatacgaatccttggctgaaagaggtgaagaacaaagtggtactcaagctttgtacaagtggtacaaggaatggtga

SEQ ID NO: 51 - DNA, 891 bp, Artificial Sequence
  HIBADHbc
atggaaatcgcattcatcggtttgggtaacatgggtggtcctatggctgctaacttattaaaggctggtcacgcattgactgtattcgacttagatgcacatgctgttgatgctgcagttagagctggtgctgcagcagcaacttcaccaagagatgctgcagccagaggttctttaatcattacaatgttgcctgccgcacaacatgttagagccgtttatttgggtgacgatggtgttttagccggtgcaagagccggtgcaaccttgatcgactgttccacaattgaccctggtacagtcagagctgttgcagatgccgctgcacaaagagacttccctttggctgatgcaccagtttctggtggtacaggtggtgctcaagcaggtactttgacattcatggttggtgctgatggtgcattgtttgaaagaattagacctgttttattggacatgggtagaaatgtagttcactgtggtggtactggtacaggtcaaatcgctaagatctgtaacaatttgttgttaggtatttcaatgatgggtgtttccgaagcaatggctttgggtgcagccttgggtatcgacccaaccgttttagcaggtataatcaacacctctacaggtagatgttggtcctctgatgcatacaacccatatcctggtgtttcagacacagcaccagctgcaagaggttatgcaggtggttttgcagccaacttgatgttaaaagacttgggtttagcaactgaagctgcaagatcagcccatcaaccagtttggatgggtgctttagcacaacaattgtaccaaagtatgtcccaacaaggtttaggtacattagacttttccgcctgcgtcaaattatacgaagcccaaccagcatga

SEQ ID NO: 52 - DNA, 888 bp, Artificial Sequence
  HIBADHma
atggctaaaataacattcattggtttgggtaacatgggtggtcctatggctggtaacttggtaaaagcaggtcacgaagtcacagtatttgatttgtccaaagacgctgtcgctgcattagtaagtgaaggtgcaaagaccgccggtactgctcatgaagccgcttcaggtgcagaatgtgttataactatgttgccagcaggtcaacacgttgaagccgtctatttgggtgacgatggtttgttagcaaaattgccagccggtacattagttattgattcttcaacaatagctcctgaaaccgcaagaggtgtagctgaagttgcaagagccaaagatattccatttttggacgctcctgtttctggtggtgtcggtggtgctaaggcaggtactttaacttttatttgtggtggttcagaagaagcttttaataaggcaaagcctatcttggatactatgggtaaaaatatcttccatgctggtgaccacggttctggtcaagttgcaaagatatgcaataacatgttgttagccatcttaatgtccggtacaagtgaagccttggctttaggtgtcaaaaatggtttagatccagctgttttatccgaaattatgaagcaatccagtggtggtaattgggcattgaatgtttataacccttggcctggtgtaatggaaggtgttcctgcttctagaaattacgaaggtggtttcttggttaacttaatgactaaggatttgggtttagccttcgacaatgctgtcaagaaccaagcttctatcccaatgggttcattagcaagaaatttgttccaattgcatgccggtcagggtaacggttctttggatttctcttcaattcaaagattatacaaacctgaatga

SEQ ID NO: 53 - DNA, 897 bp, Artificial Sequence
  HIBADHpa
atgacagatattgctttcttgggtttgggtaacatgggtggtcctatggctgctaacttattgaaggctggtcacagagtaaatgtatttgatttgcaaccaaaagctgtattgggtttagttgaacaaggtgcacaaggtgccgactctgctttacaatgttgcgaaggtgccgaagttgtcatttctatgttgcctgcaggtcaacatgtcgaatcattgtatttgggtgacgatggtttgttagcaagagtagccggtaaaccattgttgattgattgttcaactatagctcctgaaacagcaagaaaagttgccgaagctgcagccgctaagggtttgaccttgttagacgctccagtctccggtggtgtaggtggtgcaagagccggtactttaagttttatagtaggtggtccagctgaaggtttcgctagagcaagacctgttttggaaaatatgggtagaaacatctttcatgcaggagatcatggtgctggtcaagttgcaaagatctgcaacaacatgttgttgggtattttaatggctggtacagccgaagctttggcattaggtgttaaaaatggtttagacccagctgttttgtccgaagtcatgaagcaatcttcaggtggtaactgggcattgaatttgtataacccttggcctggtgttatgccacaagcccctgcttctaatggttacgctggtggtttccaagtcagattgatgaataaggatttgggtttagcattggccaacgctcaagcagttcaagcttctacccctttaggtgccttggctagaaatttgttttctttgcatgcacaagccgatgctgaacacgaaggtttagacttctccagtatacaaaagttgtatagaggtaaagattaa

SEQ ID NO: 54 - DNA, 888 bp, Artificial Sequence
  HIBADHxc
atgtctaaaatcgccttcatcggtttgggtaatatgggtggtcctatggtcgctaacttgataaaagcaggtcacgaattgagagtatttgatttggttcattctgctttagacactgcacacgctgcaggtgctcaagtcgcatcttcagcctcagatacattacatggtgcagaagttgtcatttctatgttgccagcttcaaaacacgttgaaggtttgtatttgggtgacgctggtattttagctcatataccagcaggtgccttggttatcgactgttccaccattgctcctgcaatggccagaaccgttgcaactgccgctcacgccagaggtttggatatgttagacgcaccagtttctggtggtacagctggtgcagccgctggtactttaacttttattgtaggtggtgcagcccaagcattggaaagagccagacctgttttacaagcaatgggtaaaaacttgttccatgttggtgacaatggtgctggtcaagtcgcaaagttgtgtaataacatggctttaggtgtcataatggctgcaactggtgaagctatcgcattaggtgtagcccaaggtttggacccagctgtattatcacaaatgatggcagtttctacaggtagatcatgggctaccgaagtctgcaacccttggcctggtgtattggaaaatgcccctgcttccagaggttatagtggtggttttggtaacgatttgatgttaaaggacttgggtttagttgctgaagccgctgtccaagcaggtgcctccattcctttgggtgaattagctagaaatttgtacgcaatgaacagtagagccggtaatggtgctttagatttctccagtgtagttaaattggtcgctaaggtatga

SEQ ID NO: 55 - DNA, 762 bp, Artificial Sequence
  HPDHam
atgacacaacaaacagtattcgttacaggtgcctccgcaggtttcggtgccgccatagcaagaagattcgtagcagaaggtgccagagttattgccgtcgctagatctgaagataaattggaaaagttagccggtgaattgggtgacgctgtattgccagttaaattagatgtctcagaccctgaagcagtaaaggaagttgtcacaaatttgccagccgattggcaacaagttgatgtattagttaacaacgctggtttggcaaaaggtttagaacctgcccataaggctgatttgcaagattgggacgaaatgatagctaccaatgttagaggtttaacccatgtcactagagcattgttaccaggtatggttgaaagaggtagaggtcacgttattaatataggttctatcgctggtacttatccataccctggtggtaacgtttatggtgcaacaaaagcctttgttcatcaattctccttgaatttgagaagtgatttgcacggtacaggtgtcagagtaaccaacgtagaacctggtatggttggtggtaccgatttttccaaggttagattcgatggtgaccaagcaaaagccgataaggtttacgaaggtactacaccattaactgctgaagatgtcgcagaaagtgtattttgggctgcaaatcaacctgcacacgttaatatcaacgtcattgaattgatgccagtagttcaatctttttcacctttgcaaatattcagagataactcatga

SEQ ID NO: 56 - DNA, 1653 bp, Artificial Sequence
  HPDHbs
atgaccgctggtaaaggtaaaggtgctaaagttgaccctgctggtggtaaagccgctactggtagattggccggtaaagttgcattggtcacaggtgcagctggtaatttgggtggtgccattattagaagattcattgccgaaggtgcaactttggttatgactggtagaactaaggaaagattagctgcagcaaagcaagctttattggacgaaactggtgttgaagaagcaagagtttttaccgtaatcttggatggtgctgatccagattcagttagagcaggtattgatcaagtcagagctgccttaggtagaattgatgttttggtcaataatgcaggttcagctggtcctagacaaacattggaaaacgtaccattgactagagccgaaatggaagcaaatggtgactcagaaacagtagctgacgccatgagaaatttgttgggtgtcagttggaacttaacaagagcagctgccccaataatgccagtaggtgcatcagtcgttaatatttccaccatcttctctcacacaagatactatggtagaacagcctatgtcgttcctaaggctgcattaaacgccttatcccaagaattagcaaaggaattaggtgcatctggtataagagtaaatacagttttcccaggtccaatcgaaagtgaaagaattagaacagttttcgcagctatggatgccttgcaaggtgaaccagaaaactctactgcaaatcatttcatgggtagaatgacattggaaagagctatcggtgacgcccctaaaagaaagactttgccagttccaggtgacattgcagatgcttgtttgtttttagcatcagatgaaagtgctgccttaaatggtaacgaaatagatgttacacatggtatgcaagttagaaaagatagtagatcaacttacatgactagaccatccatgagatctttggacggtgcaggtttgaccgtcttaattgccgctggtgaagcatgggaagatgcattagatatggctaagatccaagctgcatgtggtgccagagtcttattgggtatgactagacaagttgacgtcgcacaagccgaagccagagttaaagctcaaggtgctgaagaaggtttaaccatcatgagattcaacagagctgaacctgatggtatggaagcagccataagagcctattctgatgcacatggtgcaatccactctgccatcgttttacctgtaaagccagctggtcatttcggtgactctttggttgaagcttcagatgcagaagttgacgctttgattgatatcgaattaaccggtgctattgcagttgccagaaccttgagaagatactggaaaacatgctctgacttgatgcaagatccaagattcgtctttatgtcaggtccatctgatggtaaaggtaacaaagcaggtagaatattagcagccgcaatagcccaattaatcacaatttggagagatgaatctagagtagactttgcacaaggtagacaaaagagagccgcatggggtaatcaaatagttagatacacaaatgaagaagatgaaaacaccagattcgccgcaggtcatgctactagaattgttttcaaggaacaaaagataactgaaacttccttgtacttgccttaa

SEQ ID NO: 57 - DNA, 1653 bp, Artificial Sequence
  HPDHca
atgagtggtacaggtagattggctggtaaaatagcattgataacaggtggtgcaggtaatataggttccgaattgacaagaagatttttggctgaaggtgcaactgttatcatatcaggtagaaatagagctaaattaactgctttggccgaaagaatgcaagcagaagcaggtgttccagctaaaagaatcgacttagaagtcatggacggttccgatcctgtagctgttagagctggtatagaagctattgttgcaagacacggtcaaatcgacatcttggtaaataatgctggttctgcaggtgctcaaagaagattggctgaaatccctttgactgaagcagaattgggtccaggtgctgaagaaaccttgcatgcttctattgcaaacttattgggtatgggttggcatttgatgagaatagctgcacctcatatgcctgtaggttctgccgtaattaacgtttccaccatattctcaagagcagaatactatggtagaatcccatatgttaccccaaaagcagccttgaatgcattgtcacaattggctgccagagaattgggtgccagaggtatcagagttaataccatctttccaggtcctattgaatccgatagaatcagaaccgtatttcaaagaatggaccaattgaagggtagacctgaaggtgacacagcacatcatttcttgaataccatgagattgtgtagagccaatgaccaaggtgcattagaaagaagatttccatcagtaggtgacgttgcagatgcagctgtatttttagcttcagctgaatctgccgcattgtctggtgaaaccatcgaagtaacacatggtatggaattgccagcttgttctgaaacatctttgttggcaagaacagatttgagaactatagatgcatctggtagaacaaccttaatatgtgctggtgaccaaattgaagaagttatggctttgactggtatgttaagaacttgtggttctgaagttattataggtttcagatccgctgcagctttggcacaattcgaacaagccgttaatgaatctagaagattggcaggtgctgattttacccctccaatcgctttaccattggacccaagagatcctgctacaattgatgcagtttttgattggggtgcaggtgaaaatactggtggtatccacgcagctgttatcttgcctgcaacctctcatgaaccagccccttgtgttatagaagttgatgacgaaagagtcttgaacttcttggctgatgaaatcacaggtactatcgtaatcgcttctagattggcaagatactggcaatctcaaagattgacaccaggtgccagagcaagaggtccaagagtaattttcttgtcaaacggtgctgatcaaaatggtaatgtatatggtagaatacaatcagctgcaataggtcaattgatcagagtttggagacacgaagctgaattggattatcaaagagcttctgctgcaggtgaccatgtattgcctccagtttgggctaatcaaatcgtaagattcgcaaatagatctttagaaggtttggaatttgcctgtgcttggaccgctcaattgttacattctcaaagacacatcaatgaaatcaccttgaatatccctgctaacatctaa

SEQ ID NO: 58 - DNA, 1653 bp, Artificial Sequence
  HPDHcag
atgtccgtcacaggtagattggcaggtaaaatagccttgataacaggtggtgctggtaacataggttcagaaatgactagaagattcttagccgaaggtgcaactgttattatctcaggtagaaactcagctaaattggccgctttagcagaaagattgagatccgaagcaggtgttcctgctaagagaatagatttggaagttatggacggttcagatccagctgctgttagagcaggtgttgcagctatcattggtagacatggtcacatagatatcttagttaataatgcaggttccaccggtgcacaaagaagattggctgaaatcccattaaatgaaaccgatagagacttagacgatgaagaagctttgtctacaagtgttgcaaatttgttgggtatggcttggcacttaatgagaatcttaagtcctcatatgccaccaggttctgctattataaacatctccaccatcttcagtagagctgaatactatggtagaatcccttacgtcgttccaaaggcagccttgaatacattgactcaaatcgctgcaagagaattgggtatcagaggtatcagagttaacacaatctttccaggtccaattgaatccgaaagaatccaaacagtttttcaaagaatggaccaattgaaaggtagaccagaaggtgacacagcatcacaattcttggcaactatgagattatacagagctaacgatcaaggtcaattggaaagaagattcccaacaatctgtgacgttgctgatgctgcagttttcttggcctctgatgaagcagccgctttgacaggtgaaactatcgaagttacacatggtatggaattgccaacatcttcagaaacctctttattggctagaacagacttaagaactattgacgcaaatggtagaaccactttgatatgtgccggtgaccaaatcgaagaagttatggctttgactggtatgttgagaacttgtggttctgaagtcattatcggttttagaagtgaagctgcattggcacaattcgaacaagccatcggtgaatctagaagattggctggtgaatcctttatcccacctattgcattaccaattgacttgagaaacccaagtacaatagacgcattatttgattgggctggtgaaaatactggtggtattcatgcagccgtaatcttgccagcatcaggtagagaacctgcaacacaagttatagacatcgacgatgctcatgtccaagccttcttaaacgatgaaatcgtaggttccatcattatcgcatcaagattggctagatactggcaagcacaaagaatcgcacctggtgccagagcaagagaacctagagtcatcttcttgtctaatggtgcatcaactgctggtaatccttacggtagaatccaatccgcagctatagaacaattaataagagtttggagacatgaagcagccttggattacgaaagagcaaccgctgcaggtgaaagagttttgcctgcagtttgggcatcacaaatcgttagatttgcaaacagatccttagaaggtttggaatttgcctgtgcatggaccgcacaattattacattcccaaagaagaattaatgaaataacattaactatccctgccgacatctcttaa

SEQ ID NO: 59 - DNA, 1653 bp, Artificial Sequence
  HPDHct
atgagaagaacaaaaccagaatgcttgagaagaaatgaaagtacaatgagattgaacggtaaagtcgccttaataacaggtgccgcaggtggtatcggttcagtagtcacaagaatgtacttgagagaaggtgctagagttgcaatttcctcaagatccttggaaagagcagaacaattcagagcagccttaatggccgaaggtttttcaggtgacgatattttgccagtagcatttgccagtacagacttagccggtatgcaaacagctatcgaagcaattgcagctagatggggtggtttggatgttttaattaacaatgctggttcagctggtgcaaagcaacctttgttcagaatccctttcacctcagaagatttggctcaattggcagctgaaggtttcacagaaaccgaaacaatgagagaaagtgctgccaacttattgggtatgccttggcacttaacaagattggctttaccttacttgagagttggtgcttctattatcaatgtatctacaatcttctcaagaaccaattattatggtagaataccatacgtagtcccaaaatctgccttgaacgctttatccttgggtttggccaaacaattgggtaccactgacagagctgtcagagttaataccgtttttccaggtccaatagattcagacagaatcagaaccgttttcggtgctatggacagattgaaaggtgtcccagaaggtactaccgctcaagaatttttcgacattatgattttggctagagcaagaggtggtgaagcacctacaaagtgttatccaactcaagctgatgttgctcacgtaattttatttttgggttcagatgaatctgcagccatatctggtcataactttgaaataactcatggtatgcaagttaaggcacaatccagaacaaaattgactgcatggccagaccaaagattgatagatttgtcaagaagagttgtcttgattgttggtggtgaacaagtacatgatgctgtcacaatagcagcctcccaacaatcatatggtgcttcagttatcttgacattcagacaaccagaagcagttaatactgcaaaagctcaattggaatccagaggtttgaaccattctatagcagttacctggttagacccattgagaagagaatctgttacaagtgttttcgacttaatcagagaaagataccacagattggataccgttatagtttttccagctcatgccgctggtcattatggtcctgaattgatcccagatgaacctgaaagaatcagacaattcaccgatgaagctattttaggtacaaccgcattcgcagctcaattgtccagatttttattggctttcgatgcagaaaacgaattgcaagaacctgtcaacgttttgtttgtcacaaacgaacacgacggtgctacaaatgcatttgaagatatctatagagccgcagtcgaacaattgttgagagtttggagacacgaagatgaattgcaagttgcagctggtacaagaagattcgccgtaagaaccaaccaaatagtaagatatgctaatgcagaaccagacaacttgaagtttacagccgattggttggcaacattagccaacagagtcagaatctttgatgaattaaactaa

SEQ ID NO: 60 - DNA, 747 bp, Artificial Sequence
  HPDHec
atgatcgtattagttactggtgccacagccggtttcggtgaatgtattacaagaagattcatccaacaaggtcacaaggttatcgccaccggtaggagacaagaaagattgcaagaattaaaggatgaattgggtgacaatttgtatatagctcaattggatgttagaaacagagctgcaatcgaagaaatgttggcctctttaccagctgaatggtgtaacattgatattttagttaacaacgccggtttggctttgggtatggaacctgcacataaagcctcagttgaagattgggaaactatgattgacacaaataacaagggtttggtttacatgacaagagcagtcttaccaggtatggtagaaagaaatcatggtcacattataaacataggttctacagcaggttcatggccttatgccggtggtaatgtatacggtgctaccaaagcatttgttagacaattctccttgaacttaagaaccgatttgcacggtactgccgttagagtcacagacattgaaccaggtttagtcggtggtactgaattttcaaacgttagattcaagggtgacgatggtaaagctgaaaagacctatcaaaacactgttgcattgacacctgaagatgtctccgaagccgtatggtgggttagtacattgccagctcatgttaacatcaacaccttagaaatgatgcctgttactcaatcttacgcaggtttaaatgtccacagacaatga

SEQ ID NO: 61 - DNA, 591 bp, Artificial Sequence
  HPDHed
atgtcagaagcaatcactcctggtgccttagaaactttattcactggtgcaagaactcacaacggttggcaaaatatgcctgtatccgatgaaactttgagagaaatctataatttgatgaaatggggtccaacatctgcaaactgttcacctgccagaattgttttcgtcagatctgccgaaggtaaagaaaagttaagaccagcattatcttcaggcaatttggaaaagactttaactgctcctgtaactgcaatagttgcctgggatggtgaattttacgaaagattgccagaattattccctcatggtgacgctaagtcctggtttacagcaagtccagccttggctgaagaaaccgctttcagaaactccagtttgcaagctgcatacttaatttttgcttgtagagcattgggtttagataccggtcctatgtctggtttcgatagacaaaaggttgatgaagcatttttcacaggtactacattgaagtcaaatttgttaattaacataggttatggtgacccaggtaaattgtacggtagattgcctagattagactttgatgacgcctgcggtttagcttga

SEQ ID NO: 62 - DNA, 1653 bp, Artificial Sequence
  HPDHgb
atgaacgatatgtccgatattccacaagacttattaacacaaagtatagcaggtagaagattagataacaaatgtattattttaactggtgcagctggttcaatcggttcctttattacaagacaattattgagagaaggtgcaagagttatgttaacaggtagagatcaatcaaaattggacgactttattggtgacttggtatcagaaggtttcgaagaaactttcatggtttccgcaactggtgactgtgccgatcctgaagtctgtagagaaatagttgccaagacagttgccgcattcggtcctattgatgttttagtcaacaatgccggtgccgcaggtccaaaattcacattgagagatatccctttcaccgaagcagaacaaagagcagctgactcagatcaaacaatgtttgactcagccatgaatttgttgggtgctccttggaatatggccagagccgctgcaccacatatgtcagctggtgcctctataatcaacgttagtactatcttttctagaactcattactatggtagaataccttacgtcgttccaaagtctggtttgaacgcattgggtaaaggtttggcattagaattgggtgaaaaacaaggtatcagagtaaacactttatttccaggtcctattgaatccgaaagaattgaatcagttttcgccagaatggatgaattgcaaggtgttgaacctggttcaactggtaaagagtttagagatttgatgataactacaagaacctctgatggtggtttggaatataaatacccaactccaacagatgttgcatcaggtatcgtttggttggcatctgatgaatcctcagccttatctggtcatcacattgaagtcaccaatggtatgcaagtaccagcacaatctagatcccaattggtttcatggccagataagagattggaagatttgtcaggtcaagtcgttttgattttaggtggtgacgactatcaagaagcagttactttcgccgaaagacaaatccaatccggtgcaagagtaatgttagctttcagaaacttgaataccgttggtcatgctagatcattagttcaatcaagaaatttgggtgacgttcaattatcccacttggaccctttgagaagagaatcagttgacagatccatgcaattaatcgcagatcactttggtagattagatggtgtaatcttgttaccacaaaagccaaacggtgaatacggttattccttgactacagctaatgacgaagatgttgccaattttgttagagatgaagttgtcgcccctgttgcatttgcatccgctttcgcaagaaacatggatcaattgtttgccgaaggtgaaccaccagccatcgtttacgttactaaccctagtgatagacatggtaacttgatgaatgaaattatcagagcaagtgttgaagccttaatcagaggttggagacatgaagatgaaactttggcaaacactggtgaattgccttgggcagtacaaccaaaccaaatggttagatatgataccgaagatagagaagctttaactttcgcagccgactgggcagccactttaaccaacagagttagaaagatggatagtatcaacttatggttaccaagaagtattaaataa

SEQ ID NO: 63 - DNA, 759 bp, Artificial Sequence
  HPDHhw
atgatagtattagtaacaggtgcctcctcaggtttcggtagagctattgccaagaagttcggtgaaaatggtcataaagtaatcgcattggcaagaagaaaggaaagattgcaatctttacaaaaggaaatcccatactgtgaaatcttgccttgtgatatctgcgacaaaaaggctgtcaaacaagcattggaagccttaccacaagatttcaagtctatcgacattttggttaacaacgctggtttggcattaggtattgaacctgcccaaatgtgcgatttcaaagactgggaaagaatgatatcagttaatgtcactgctttgtcctatttgacacatttggttttaccacaaatggtcgaaagaaaaagtggtcacattataacattgggttctattgcaggtaaatatccataccctggtggtaatgtatacggtgccaccaaagcttttgttaagcaattcgccttgggtttaagagcagatttggccggtactaacgttagagtttcagacattcaaccaggtttggctgaaagtgaattttctttagttagattcaaaggtgacaaaaagagagctaatgcattgtatgaaggttccaacgctttacaacctcaagatattgccgaagctgtctactgggtagcaacattgccaaagcatatcaacatcaacaccttagaaatgatgcctacttctcaatcattttccacattggcagttcacaaagaatactcattcttaaccaagtga

SEQ ID NO: 64 - DNA, 804 bp, Artificial Sequence
  HPDHka
atgtctcaaggtagaagagcagccgatagattagccggtaaagtcgtattgataactggtgcctccgcaggtattggtgaagccactgcatgggaatatttgtttgcatccaatggtcaagccaaattgatattgacagccagaagattggaaaagttggctgctattaaagaagaaatgaaaaaggaatacccaaacgttaagatacatgtcgctaagttggatgtttctaacacagaagaaatcaaatcattgttacaatgtttacctaccgagtttaaatctattgatatattggtcaacaacgccggtaaagctttaggttcagaaaaagtaggtgacattgctattgaagatataaagggtatgatggatactaacgttataggtttgattaatgtaacacaagcagttttgccaatcttgaaggaaaagaactctggtgacatcgtcaacattggttcagtagccggtagagatgcttatcctaccggttctatatattgcgctagtaaatttgcagttagagccttcaccgaatctttgagaaaggaattgttggatactggtattagagttatattgatcgcaccaggtttagtagaaactgaattttccttagttagatacaagggtgacgaaaagagagccaatagtgtttacgaaggtatcactgctttggaagcagaagatgttgctgaattaatcgttttctctacatcaagaaaaccaaacactgttatagctgatacattgatctttcctacctgtcaaggttccgcattccatgtccacagaagttga

SEQ ID NO: 65 - DNA, 945 bp, Artificial Sequence
  HPDHms
atgacagaaaaagtatcagtagtaggtgctggtgttattggtgttggttgggccacattattcgcctctaaaggttattcagtatctttgtacacagaaaagaaagaaaccttggataagggtatagaaaagttgagaaactacgtacaagttatgaagaacaactcccaaatcactgaagatgtcaacacagtaatctccagagttagtccaactacaaatttggacgaagctgttagaggtgcaaactttgttattgaagccgtcatagaagattacgacgctaaaaagaaaattttcggttacttggattctgtcttggacaaggaagttatattggcctcttcaacctctggtttgttaatcactgaagttcaaaaggcaatgtcaaagcatccagaaagagcagttattgcccatccttggaatccacctcacttgttaccattggttgaaatagtccctggtgaaaagacttctatggaagttgtcgaaagaaccaagtcattgatggaaaagttggatagaatcgtagttgtcttaaagaaagaaatccctggttttattggtaacagattggcctttgctttattcagagaagctgtatatttggttgacgaaggtgtcgctactgtagaagatattgacaaagttatgacagctgcaataggtttaagatgggcttttatgggtccattcttgacctaccatttgggtggtggtgaaggtggtttggaatatttctttaatagaggttttggttacggtgcaaacgaatggatgcacacattagccaagtatgataaattcccttacaccggtgttactaaggctatccaacaaatgaaggaatactcctttatcaagggtaaaactttccaagaaatcagtaagtggagagatgaaaagttattgaaggtatacaagttagtttgggaaaagtaa

SEQ ID NO: 66 - DNA, 1653 bp, Artificial Sequence
  HPDHot
atgtttatgacaagattgaatgacaagattgctttgattactggtggtgctggtactataggtgaagttattacaagaagatatttggaagaaggtgcaacagtagttatggctggtagaaatagagacaaattagacagatatagagaaagattgataactgaatttcatgctttaccagaaagagttatggtagttagaatggacggttcatccaacgcagaagttagaatgggtattgccgctgttgtagcccactttggtagaattgatatattggtaaataacgcaggttcagctggtgccagacaaagattgccagctatcccattattgagatcagaattgcaagcagacgaaaccgaaactttggcagattcaatcggtaacttaataggtatcacatggaatttgattagagctgcagctccattcatgcctgcaggttcctcagttatcaatattagtacaatctttgctagaactgactactatggtagaatcccttatgttgtaccaaaggccgcattacacgccttaacattggcagccgcaactgaattaggtgaaagaggtataagagttaaccaaatcaacccaggtcctatcgactcagatagaattagaactgtttttagaagaatggatgaattgaagggtgttccagaacaatcaactgctgatggtttctttcaaatgatgagattgagaaggcctaatgccgaaggtgacttagttaagggttttcctaagactttggatgttgccaacgttgctgtatttttaggttccgcagaatcagctgcattgtccggtgaaacattggatgttacacacggtatggcagttccaacagaatcaagaacaactttgacaagtagacctggtttgagagcagtagacggtagtggtcacacaacattaatttgtgttggtgaccaaatcgaagaagcagcagccttaactggtgtattgagagcatgtggtgccgaagtagttatcggttttagatctagagccgcaatcgctagattcgaccacttgatcgaaagaggtagacacttaccatctcaagaacatgttgcccctgttttgttatatttgaatcctacagaaccagaatcaatagaccaagccttgagatggatggccactaacttagacttgcctacaagtgtaatcattttgcctgcacaaagacaaccattacctcctagtgttgttagagcctcagatgaagaagttgcatactttttaagagatgaattgagtggtatgatcgtcttggcaagtagattagcaagattctggcaacaagcaacattggcacctggtaatgcacctattcaaccaagagttttattcatgacaaacccagacgatggtcaaggtaacttatatgcagaaatattgagagcaggtgttgaacaattgtgtagagtttggagacacgaatcccaattggattatactagattggcccaaatggatgcacatccacctcatattagaccagtttgggcaaaccaattggttagatttgccaacaatgaacaagaaaatttggaatactgctgtgcttgggttgccaagatattgttatccgaaagaacaattgaagaattaaacttatacttgcctagacaaatataa

SEQ ID NO: 67 - DNA, 816 bp, Artificial Sequence
  HPDHps
atgtcctatggtagtaaggccgcagaaagattggctaacaaggtcattttaataacaggtgcttccgccgccgctggtatcggtgccgcaaccgccagagaatttgctgaagctgcacatggtaacataaagttgatcttgacagcaagaagaaaggataagttggacgctttagcaaaagaattgaccgataagtatgacaacattaaagtccacaccgtagccttggatgttactaagttagaatctattggtcaattcgtcaaggatttgcctcaagaatttgcagatatagacgttttagtcaacaacgctggtttggcattaggtagagatccaatcggtgaaattttgcctgaagatatacaaggcatgttccaaacaaacgtattgggtttaatcactttgacacaagcagttttgccaatcttcaaagctaaaaattctggtgacatcgttaacttaggttcaattgctggtagagatccatatcctggtggtggtatctattgtccaactaaagccgctgtaaagtctttctcacatgttttgagaaaggaattgattaatacaagaatcagagttttggaagtcgatcctggtaacgttgaaaccgaattttccatcactagattcaaaaacgatgttgataaggccaaggctgtatatgctaacactgaaccattagtcgccgaagatattgctgaagtaatagtttttggtatcacaagaaagcaaaacaccgttattgcagaaactttgatattctcaacaaaccaagcatccgccagtcacttatacaaaggtcaagtttga

SEQ ID NO: 68 - DNA, 750 bp, Artificial Sequence
  HPDHra
atgataatattcgtcacaggtgccacagcaggttttggtgcagaaatcgcaagaaagttcgtaaaggaaggtcacaaggtaatcgcaacaggtagaagaaaggaaagattagatgacttgaaggctgaattaggtgacgctttgtatgccgtcgaattagacgtaaccaatagagcatctatagaagaagctattgcttctttgccagctgattggcaaaacattgacgttttggtcaataacgctggtttggcattaggtttggaaaaagccgataaggcttccttggaagattgggacaagatgatagatactaacacaaagggtttagtttacatgaccagagcagtattgccaggtatggttgaaagaaataccggtcatgttattaacataggttctactgccggtaattggccttatgctggtggtaacgtctacggtgcaactaaggccttcgtaagacaattctcattgaatttgagaaccgatttgcatggtactcacgttagagttacaaatattgaaccaggtttgtgtggtggtacagaattttccaacgttagattcaagggtgacgatgaaaaagtcagtaagacctacgataacactaaccctttaacagctgcagacgttgctgaatccgtcttttgggctagtacattgccagcacatgttaacatcaactctatcgaaatgatgcctgtttctcaatcattagcaggtttgcaagttcacagagaaggttga

SEQ ID NO: 69 - DNA, 1653 bp, Artificial Sequence
  HPDHrc
atgtctacagtcagaagattggaaggtaaagttgcattgataacaggtggtgccggtaatataggtgaagtaataacaagaagatttttggcagaaggtgctaccgttgttatcacaggtagaaatgccgaaaaattggctgtctacagaagaagattaattgacgaagaaagagtagcaccagaaagagtcgttgctttgagaatggatggttctgacattgcccaagttagagctggtgttgctcaaattgttcacggtggtacagatgtcccaatcccattgcatagaatagatatcttggtcaacaatgcaggttctgcaggtccaagaagaagattagttgatatccctttggaaccatccgaagttcaacctccagattcagaaactttggcacaagctgttggtaatttggttggtataacatggaatttgacaagagcagccgcaccacacatgccatccggttcatctgttattaacatctctacaatcttctcaagaaccgattactacggtagaatagcctatgtagcacctaaggctgctttgaacgcattatctgacggtttggccagagaattgggtgttagaggtatcagagtcaataccatatatcctggtccaatcgaatcagaaagaatctacactatgtttcaagctatggacgctttaaagggtcaaccagaaggtgacacagctagtggtttcttaagaatgatgagattgtctagaatcgaccaaaacggtgaagttgttaagagattcccaagtcctgtagatgttgcaaatactgctgtattcttggcatctgacgaaagtgcagcttttacaggtcatgcctttgaagtcacacacggtatggaagttccaaccgaaagtagaaccactttcgtttccagaccaggtttaagatccgttgatgcaaccggtaaagttattttaatatgtgccggtgaccaagttgatgacgctgtcgcattggctgatacattgagatcatgtagagctaccgttgtcatcggtttcagagatccaagagcattagaaaaggcatccgttttgttgagagaacctagacacgctttggcagctgacatgtacggtagacctacaatgactgcagaagctagattggtcagattagatcctttagacccaagagcagctgcccaaactttggaacaaatacatgccgaattgggtgccatccaccatgctgtcgtattgcctggtcaatctagacatgcaccttcagcttccttgatcgaagttgatgaccaagttgttgaaagattcttacaccaagaattagttggtactattgccttagcaagagaattggccagattttgggaagaatatccatccggttcttcaatgcatagagttttatttgtttccaatcctgacgatcaacaaggtaaccaatacagtcacatcttgagagctgcagttgaacaattagtcagagtatggagacacgaatccgaatatgactccgttaaccctgcacaccaacaagaaggtcaatcctcagcagctgtttgggctaaccaattaataagatatgttaataacgaaatggctaacttggacttcacttgcgcctgggttgccaagttattaggttccgatagaagaatctaa

SEQ ID NO: 70 - DNA, 969 bp, Artificial Sequence
  HPDHsi
atgtttatccacatgaagagtattaacaaagtagccgtagtaggtgctggtattatcggtgtaggttggacaactttattattgactaaaggttacaaggttaatttgtacaccgaaaagaaagaaactttagaaaagggtttggcaaaggtatctgcctatttggttaatttgaaaaatttgagaatgatagatggtgaaccaatcgactaccaaagaaatttgacaggtactacaaagattgatgaagccattcaaaacgttgaatttgtcatcgaagctatcatcgaagattactccgctaagaaaaatttgtttaattacttggatagtcaattgcctagagacatcattatagcatcttcaacatctggtttgttaatgaccgaaatccaaaaggctatgaccagatatccagatagaggtgttatcgcacatccttggaatccacctcacttgttaccattggtagaaattgttccaggtgacaaaacctcaaagtacactttggatgttacaaaggacttcatggaaaagttggatagagttgtcgtagttttgaagaaagaagttccaggtttcattggtaatagattggcctttgctttattcagagaagcagtcaacttgatagatgaaggtgtcgccactgtagaagatattgacaaagttatgacagctgcaataggtttaagatgggcttttatgggtccattcttgacatatcatttgggtggtggtgaaggtggtattgaatactttttctccaaaggttttggttatggtgccaatgaatggatgtacaccttggctaaatgggataagttcccttatactgctgttaaaaagatcgttgatcaaatgaaggaatacgagtttattaagggtaaaaatttccaagatttgtcaagatggagagatgaaactttggttagagtatacaaggcagtttttggtgaaaagagatga

SEQ ID NO: 71 - DNA, 1653 bp, Artificial Sequence
  HPDHsl
atgaatgcaatgggtaaaacagaaacacaaggtagattagctggtaaagtagccttgataactggtgccgccggtaacttaggtggttctatcgtaagaagatatttggccgaaggtgcaacagttgtcatgtccggtagagatgctgccagaactcaagcagctttagatgcagcagtagctgacgttggtggtactgcttcaattgtcactatggatggtgcaaatatcgaatccgttagagcaggtatcgcagatgttgtcgcaagacatggtagaatagacgtcttggttaataacgcaggttcagctggtccaaagcaagttttgggtgacttacctttgttgccagaagaattggaaggtacacctgattcagaaacagttggtgacgcagcaagaaatataatggttgtcgcatggaacttagttagagctgccgcatctgctatgggtgaaggtggttccatcattaatgtttccacaatattctcaagaactgattattttggtagagcagcttatacagttccaaaagctgcattgaatatcttatccaaaggtatcgcaagagaattgggtaccagaggtatcagagtcaatcaattgtatcctggtccaatcgcctcagaaagaatcagaacagttttcgccgcaatggataagttgaaaggtgacgatgccggttcaactgccaaccatttctttaatttgatggctttggaaagaagtgtaggtgaagatgccaaagcaaagaccttccctacaccagctgatatcgcaaacacttgcgttttcttgggttcagacgaatccgctgcctttgcagcacacgactttgaagttacacatggtatggcagtacctttggaatcaaaatccgaatttttgcatagacctgacttgagagcaatagatggtgacggtcatggtatcttgatttcagccggtaaccaattagacgatgcattggctatggcaggtttgttcgcagcacaaggttcaaaagtcttgttgggttttcacgcacaagctgcattggacgatgcagcagaaagattgccagccggtgtcaaagcagttagatttccaagacatgaccatatggcaatggacgctgaattggccagattcacagcacatgtagccgcaattgacggtgctattatattgccaacaagaggtccaggttactttcatggtgcattgaacgaagcttccgacgctgccgttgaaagatttgtcgatgacgaattggaaggtgcaattgctgttgcaagaacattagatagatattggcaacaaggtcaagacttgcctggtgaccctagagtcttgtttatcacaaaccctgatgatggtgcaggtaatggttgggcagatgttggtagagcagcaatcgaagaattgttgagagtttggagagatgaagctagagtagccgcaacacaaggtaaaactcctagacctgtttggggtaaccaaattgttagatttggtaataacgaaccagaaaatagagactttgctgcaggtcatgccgcaagattgttattaggtggtagacaaatagaaccaatcaatttgtacatccctgcatctatcacaaaagccactggtgccagaagagccttagcaggtaccgcagaataa

SEQ ID NO: 72 - DNA, 867 bp, Artificial Sequence
  HPDHsm
atggctatcttaatcactggtgcctcatcaggtttcggtgctgctatggctactgccttcgtccaagctggttacttagtcatcggtacagctagaagaaccgaaaaattagcagatttgcatgccaagttaggtgacagatttcaacctataactatggatatgacatcaaaggatgacattcaagctgcattagcacacatacaaaccttgccagaatacttcagagaaatagattgtttgatcaataacgctggtttggcattaggtttggatagagccgaccaagctgatttcaccgactgggaaactatgatccaaacaaacatcatcggtttaacctatttgactagacaaatattgcctaagatggttgaaaataagagaggttacatcattaacatgggttcaattgctggtaattatccatacgcaggttccaacgtctatggtgcaactaaggcctacgttagacaattctctttgaatttgagagctgatttgcatggtaccggtgtaagagttactaatatagaaccaggtttggttgaaggttctgaattttcaaacgtcagattcaaaggtgacgataagagagccgctcaattatatgaatacgcaaacgccttgacaagtgaagatatagctcaaaccgcattatggttgtatcaaagacctgcccacatgaatgttaacactatcgaattaatgccaactacacaatcttgggctggtatgcaagtttacaaagatacaccacctccacctccacctgttgtcgaaccaaagcctgccgactttgctccacaacctgctccacaagaagaatccggtttcttttctaagatcacatctttgttcaagtga

SEQ ID NO: 73 - DNA, 957 bp, Artificial Sequence
  HPDHst
atgagacaaatcaagacagtcagtgttattggtgctggtgttataggtgctggttggtccacattattggcattgaagggttacgaaaattggttttacactgaaaagaaagaaacattggataaaggtttggctaaaatcaagggttacttaaatgttttgtatgaatacaaattaattgacaaagaaccagattattacatgcaaagaatacatccaaccacaaaattggacgaagctatttccaatactgacttcgtcttggaagcaattgttgaagaatacggtgctaagaaagccttgttcaaacaattggacgaaaaattagataaagacgttatcttagcatcttcaacttccggtttattgatgactgaaatccaaaaggcaatgacaaagtacccagaaagaggtattatagctcatccttggaatccacctcatttgttgcctttggtcgaaatcgttcctggtgaaaagacatcacaagacaccatctacgcaacaaaggattttatggaaaacaagttggaaagagtcgtcgtagttttgaaaaaggaaatcagtggtttcataggtaatagattggcctttgcattgttcagagaagcagtttacttggttgatgaaggtattgccactgttgaagatattgataaagttatgacagctgcaatcggtttaagatgggccttcatgggtccatttttgacttatcacttaggtggtggtgaaggtggtttggaatatttcttttccagaggtttcggttatggtgctaacgaatggatgcatactttagcaaagtatgataagttcccatatactggtgttgtaaagtcagttcaacaaatgaaagaatatgaatttgtcaaatccaagacattccaagaattgagtagatggagagatgaaaagttgataagtttgataaagttgttgagaggtaaaatataa

SEQ ID NO: 74 - protein, 480 aa, Artificial Sequence
  AADHab
MEINEKDLKLIIENVLDKLESDKSDKKIFDSSLNIPSSGQDGIFEEVNAAVDAAEAAHLELMKLTLEKRREIIRSIRKIIMSNLEEISKLAVEETTFGRVEDKIEKNRLAALKTPGIEDLEPTAYSDDNGMTLMERAAYGVIGSIIPSTNPTSSVINNGISMIAGGNSVVFNPHPAAKRSSCFTISLINQAIVKAGGPPNVLCAIANPTIDSAQTLMKHPKIKLLVVTGGPAVVKTAMNSDKKVIAAGPGNPPCVVDETADLVKAGRDIVNGAGFDNNIVCICEKEILAVSQIADQLKEEMIKNGAHELKGEQIEKVTKLVITDPGKPGHEGAPNKKYVGKNASVIARDIGLDISEQTKILLCEVDRYHPLVWTEQLLPVIPLVRFNNVDEAIDFAVQCEHNFRHSASIHSKNIATLSRMAKLMNCSLFIKNGPNYSGLGFGGAGYTSFTIATPTGEGLTRARTFTRERRCVLVGYFRIV

SEQ ID NO: 75 - protein, 477 aa, Artificial Sequence
  AADHal
MVDQTLIEQITRAVLTQMKAGKDAAVSGDGIFATVDQAVAAARQAYQELRLLTLEKRETLIRAIRDAAFANAAVIAQMAVQESGMGRVEDKILKNQLAARKTPGTEDLTSRAWSGDHGLTLVEMAPYGVIGAITPTTNPSETVICNSIGMIAAGNSIVFSPHPTAQNTSLTTIRLLNEAIVKAGGPDNLLTAVAEPSIEAANAMMRHPGIQMLVATGGPAVVKAVLSSGKKAIGAGAGNPPAVVDETADIAKAAKDIVAGCSFDNNLPCIAEKEIIAVGRIADELISYLQKYGAYLISGRDIERLMEVVLTERTEEMAPGCVGKPRRVYGVNKDYIGKDAKFILSKINIQAPDHIRVILCETPADHPFVLEELMMPVLPLVSVRDIDAAIDLAVKVEHGNRHTAVMHSKNVDYMTRLAKAIETTIFVKNAPSYAGIGVGGEGFTTFTIAGPTGEGLTSARSFTRQRRCALVDAFSIV

SEQ ID NO: 76 - protein, 464 aa, Artificial Sequence
  AADHbs
MDEIMIKNIVREVLMKTNLDISCKSDQGVFEDVNDAIDAAYIAQRDWYMNYKVEDRRRIIEAIRVVARENAPMFAKMIHEETGMGRYEDKITKNLAVIDKTPGVECLVTDAISGDSGLMIEEQAPFGVIGAITPSTNPTETIINNTISMIGGGNAVVFNVHPGAKKVCAVCLQILHKTIVENGGPANLITMQRKPDMEAVNKLTASPKIRLMVGTGGMGMVNALLKSGKKTIGAGAGNPPVVVDDTADLDKAASEIYRGASFDNNLLCLAEKETFVMDNVADELIRKMCACGAHLITPQETEQLLKVIFLEKDGKYSVNKKWVGKDASLILESIGIKDADTRLVLCEVPHDHPFVLVEQLMPIMPIVRCKTFEDCVKYAVVAENGNRHTASMFSKNVDHMTRFAKEIETTIFTKNAATLVGVGIGGEGHTTMTIAGPTGEGLTCARSFTRRRRCMLADGGLRVI

SEQ ID NO: 77 - protein, 484 aa, Artificial Sequence
  AADHbw
MDVRQQDVERIVVEVLKKMMSDQPTAAATTVVAASGCDCGDFGLFDRLEDAVQAAEAAQKKISTVAMRDKIIAAIRKAGLENAKAFAEIAHNETGMGRVSDKIAKNILVCERTPGTECLSPMAISGDMGLTLIENAPWGVIASVTPSTNPTATVINNAISMIAGGNSVIFAPHPNAKRASQTAIQVLNKAIIEATGVANLLVAVKEPTIEVAQELFSHPRIKLLVVTGGEAVVAQARKVATMRLIAAGAGNPPVVVDETANIARAARSIYDGASFDNNIICADEKEIIAVDSIADQLKAEMKAIGAVEISLEQADAVARVVLRNYPQVEGGKAPNPNPKWVGRDAALIAKAAGIDVPDSCRLLIVDVKRDINHVFARVEQLMPVIPLLRAANVDEAIEWALILERGLSHTAGMHSRNIDNMDKMARAMNTSLFVKNGPHLAALGAGGEGWTTMTISTPTGEGVTCARSFVRLRRCCVVDNFRIV

SEQ ID NO: 78 - protein, 437 aa, Artificial Sequence
  AADHcs
MKSSIYSSVSEAVMAARGAFNRYADLTLNERKEIIEAVKAAVRPRITQLAEMTAAETGMGNVADKIEKIRLAVEKTPGVEDLITEVNTGDHGMTLYELSAFGVVCAVHPCTNPCATLISNTIGILAAGNAVVHCPHPRAVRVSQYLTGMISDAVRDVCGIDNLVVTVGESLMGSTREIMSHPDVDLIVCTGGSGPLRQAMSAGKKVIGAGPANPVAIVDETADLERAARDIVKGASFDNNLMCTSEKSIVAVEKIADELISHLERNGVYYTRSAEEIDRLYCTAVTEDFVINKKMEGQSADVILDAAKIPHRKGIKLIVAETDRTHPFATLELLMPLLPLVRARDFDEALEAALDIEQGFRHTATIHSESVERMNRAAKKLQTAVFVKNGPSLLGIGFDKEGHTSFTIGTITGEGTTSARHFARRRRCTLTSGFSIR

SEQ ID NO: 79 - protein, 485 aa, Artificial Sequence
  AADHho
MALREDRIAEIVERVLARLDGNSGSSAAPHSGSGAPAATAGGASLDIPRGTLGVYADADAAVNAARRGFAANEALPLRTRQAMIDAMRKVARAHIPELARYAVAETGLGRYEDKLAKNELVIAKTPGPEILAPVAYTGDDGLTLTERAPYGVIGAITPCTNPTETVICNAIGMLSGGNAVVFNVHPSAARVCNWLVHLLNEAIMSVGGPRDAITSVESPTIDSAQTLMTHAGVRLVVVTGGPGVVRAAMKSGKKVIAAGPGNPPAVVDETANLAKAAAAIIKGASIDNNIICTAEKEIVAVASIADELSRLLGQRGALVLGDAQVRALERVVLDGEHVNKEWVGKDASRIAEQIGLRGHGSDLRLLVCPVDEGHPFVQHELLMPVIGLVRVSDATEAMATAVRVEHGFCHTAVMHSTHIDRLSAMARVCNASIFVKNDCNLAGLGLGGEGFTSFTIASPTGEGLTTARDFTRVRRCTLKESFRFV

SEQ ID NO: 80 - protein, 467 aa, Artificial Sequence
  AADHhs
MKIKENELDKIVNQVISSLNNKQNSNDFNTKINYGIFSTMDEAIAEAVKAQACLQLNYSTEAREKIIKSIRKNVSKHVEKISEMAVEETDMGRIEDKIIKNNLAINKTPGTEDLRTEAFSGKKGLTIVEEAPFGVICSIAPVTNPTETIISNAISMIASCNGVVFNSHPGAKKVSKYIIEVLNKVIMEAGGPENLLTAVNEPTLQTVESCMRDDRIAMIVATGGPGVVNAALSSGKKAIGAGAGNPPVLVDDTVDLKRVAKDIINGASFDNNLPCTSEKAIVALESIADSLLNEMTNQNAQLVHDIKALERVILNDDGSINKALVGKDAAFILNKAGLKAKSEDLRLVIVDVDLRHPFVQKEQLMPVIPLVRAKNFNEAMEMGVDIEEGNRHTAIIHSKNVDNLTKFAKKIETTIYVKNAPSYAGIGAGGEGYATFTIAGPTGEGLTSARSFTRKRRCVLVDGFSII

SEQ ID NO: 81 - protein, 465 aa, Artificial Sequence
  AADHma1
MQTDAQQIESIVRRVIEQLHSPQRDGESYGVFRTLDDAVAGAQGAYKKIRTMAQREAIIAAIRRTGSENVQALSELAVQETGFGRVEDKIRKHRLVLDKTPGIEAIVPMAVTGDHGLSLIENAPWGVIASVTPSTNPSATILNNAISMIAAGNSVVFSPHPAARAVSQRTIQLINRASVSAGGPANLVTCVEEPTIEAATRLFSFPGIQLLTITGGEGVVNAARKVTDKRLIAAGPGNPPVVVDETADIERAAISIVQGASFDNNIICVDEKEIIAVESIATELKTAMCRHGAAEINADQADAVARLVLAGYPGPNPHPKPEWVGRDAEKIAAAAGFSVPAGTRLLVTETERDHAFATTEMMLPVISLIRARDADQAIDWAVELEAGNRHTAAMHSRNIDNLSRMGLEINCSLFVKNGPCLAGLGAGGEGWTSMTISTPTGEGVTNASTFVRKRRCTMVDSFRIV

SEQ ID NO: 82 - protein, 473 aa, Artificial Sequence
  AADHma2
MAFNEDLIASIVEQVLKEIQDDDHVIASARQSVVKANDNWGVYTDVDEAMEVVNKAQKEFAAMPISKRDEIISAIRTAGVENAEHLARIAHEVTGYGRIEDKTVKNRNAAMLTPGIEDLQKEFLSGDGGSVIVEYGPMGVIASLMPSTHPTAFVINHAIAMLAAGNAIFICPHPKAQAATLEAMKALNKAIVEAGGPKYLMVAVDKADMETSNKVYAHPYVKMVAAAGGEGVIRAALKSGKKAITGGPGNPPVVVDETADIAKAAKDIIDGESYDNNVLCIAEKEVFVVESVVDRLIAEMQKNNAYLIKGQDVANLTGVTIKDGKPNGQLVGKNPSVILKEIGIEVGDDVRTVIFEAPPEHPLVMIEQLMPVLPIVRVKDFDEAVKWAVKAEHGDGHTAILHSNNINRITEYARAMQVTVLVVNAPSYSCMDPQSKTLVYAHTLTGPTGEGFCTPRHFTRQERIVLGGAFHFV

SEQ ID NO: 83 - protein, 478 aa, Artificial Sequence
  AADHmm
MDQKEIENVVKAVLASMSAGTQPAAASAAPQQAAASQNNGFGVFESLDDAVLAAKEAQKSLKTVEMRNLCIGAIRRAATEHARELAVLAVEETGMGRVEDKLAKNLAQANGTPGVECLRPEVLTGDHGLTLIENAAWGVIASVTPSTNPAATAINNAISMIAGGNSVIFAPHPAAKKVSQRTITILNEAIVAAGGPNNLLVTVAKPDIETAQRLFKYPGIGLLVVTGGDAVVESARKHTNKRLIAAGAGNPPVVVDETADIERAAKAIVHGASFDNNIICADEKVLIAVDCIADKLITEMQRNHAVLLTREQSEKLIPVLLKNVDETGHGTVSRDWVGRDAAKIAAAIGMTVPADTRLLIAETDCKHPFAVTELMMPVLPIIRVKDVDQAIDLAVKLEGGCHHTAAMHSNNISNLNRMANAIDTSIFVKNGPCIAGLGLGGEGWTTMTITTPTGEGVTCARTFVRLRRCTMVDSFRIV

SEQ ID NO: 84 - protein, 477 aa, Artificial Sequence
  AADHpa
MEIQNLEEDIRRILSEELKKSGTSQTASTSDAGQNGIFKTVDEAIAAAKAAEDVYIDKTLAFREKVLTAIREGFRPYIEKMAKDIKDETGMGTVEAKIAKLNNALYNTPGTEILQPEAETGDGGLVMYEYAPFGVIGAVGPSTNPSETVIANAIMMLAGGNTLYFGAHPGAKKITRWTIEKLNELVYEATGMKNLVVSIEEPSIESVQEMMQHPDIAMLSITGGPAVVHQALVSGKKAVGAGAGNPPAIVDATANVALAAHNIVDSASFDNNILCTAEKEVVVESSVKDELIKKMQEEGAFLVTNASDIDKLAEMTIGKNGAPDRQFVGKDATYILDKAGIAYTGTPKLIILEAQKDHPLVTTEMLMPIVPVVSCPTFDQVLATAVEVEQGLHHTASIHSENLPNINRAAHRMNTSIFVVNGATYVGTGVGANGAHAGASALTIATPTGEGTATAKTFTRRRRLNSPEAFSLRSWEA

SEQ ID NO: 85 - protein, 477 aa, Artificial Sequence
  AADHpb
MQTTEATIRNVVQEVLAQLAKQSNGSNGVPRAERKAGDWGVFDDTDQAIAAANEGFRALSSKGMEERAKIVEIVKRICADQAEELGRLEFQETKVGRLDHKIEKLQIIKKVPGTEWLRTEAMSGDHGLTVIEYAPFGVIGTITPVTHSLPTLAGNVINMVAAGNTLVVNPHPSGKKIACEGVRRFNRAIYAATGLENVITIVSNPTLESADRIFNHRDVKMLCVTGGPGVARAAMASRKKAVVAGPGNPPVLVDESACLQNAAESIIAGAGYDNNLLCIGEKEVFVVESVFDRFMQEMDKAGAVRLNASQVDQLSKVAFTPPENEKDHYHVNRDLVGQHPYVLAKQIGLPLPESTPLLFGETDEHNPFVAEEQMMPFVPIVRCRNAEHGMDLCEKYEHGFRHTSLIHSRNVRNMSIMGKRMDTTLFIKNGPSPAGLGLGGEGYLSFSIATPTGEGVTTPLTFTRQRRCTMVDDLRIV

SEQ ID NO: 86 - protein, 452 aa, Artificial Sequence
  AADHpe
MEIKEMVALARKAQKEYQATHNQQSVDNICRAAAKVIYENAEMLAREAVDETGMGVYEDKVSKNRGKSKGVWYNLHDKKSVGILNIDERTGMIEIAKPMGVVGAVTPTTNPIVTPMSNIIFALKTCNAIIISPHPRSKKCSKHAVDLILEAIKPFNVPEGMVQVIEEPSIEMTQQLMGAVDVVVATGGMAMVKSAYSSGKPSYGVGAGNVQVIFDSDIDFEDAAEKVIYGRSYDNGIICTGEQSVIYNEADKDAVFAALRKRGAYICTEEEGKKMRDLLFQNGGPINKDVVGQGVQKIAKMAGINVPEGSRVIIVEANGVGEEDVICREKMCPVMCALSYKHFEEGVDIACRNLANEGNGHSCAIHSNNQAHIILTGSKATVSRIVVNAPSATTAGGHIQNGLNVTNTLGCGSWGNNSISENFTYKHLMNISRIAPLNPAIKVPNDQEIWEL

SEQ ID NO: 87 - protein, 460 aa, Artificial Sequence
  AADHrw
MTVTATLDADLAALADVRAQVSATKKAFDAIEGADQQWLDEIVRAMAKAGYDASEELARMAVDETGYGVYENKIIKNRFNTGFVADWMLERRAVGVLWADEENKVTAVGSPMGVIAAIIPVTNPTATVLFKSLASVKAGNAVVHAPHPRAARCSARAAEIMAEAAVHAGAPENLVSCLRQPTLDATRELMRHGDIRLVLATGGPAMVAAAYSSGKPTIAVGAGNVPAYVDSTVKDLAETATMIVTSKSFDNGTACVAEQSVVIAAPVADQLVQELGRAGATWMTKDQQAALTRTLFDERGGLRANAVGQSAVRLAEMSGFTVPASTKVLAAELDEVGDHVLLSREILGPVLTVYREPDYQAGWRRCREILALGGEGHTVAVHTSDPEVVAKFGELPAGRIVVNTPALFGGMGYSTNVDPSFQIGTGTWSGSICSDNVTPLHLVNIKRIAHEARPWRGVFD

SEQ ID NO: 88 - protein, 871 aa, Artificial Sequence
  AADHsl
MAIEEHSLNDKESKKETLEETIDLLVTNAKTASEEFTPLDQQQIDEIVRQMALAGLDQHMQLAKMAVEETKRGVYEDKMIKNIFATEYIYNSIKKNKTVGVISEDPYEEIVQIAEPIGVIAGVTPVTNPTSTTMFKSLISIKTKNPIIFAFHPSAQKCSAAAAKVVRDAAVKAGAPKNCIQWIETPSLEATQRLMHHPGVSLILATGGSGMVKAAYSSGKPAIGVGPGNVPAYIEKSADVKQAVNDLILSKTFDNGMICASEQAVIVDQQIYEAVKKEMIDNKCYFLNNEEKKKVEKLVIDERRCAVNPQIVGKTAAFIAGLAGVTVPEDTKVIVAELSSVGPESPLSREKLSPVLACFRAKTTEEGFKRCEEMLAFGGIGHSAVIHSNDQKVIDAFAMRMKAGRLIVNAPSSLGGIGDIYNHFIPSLTLGCGSYGGNSVSTNVGTANLINIKTLANRRNNMQWFKVPPKIYFEKNATKYLSVMPDITRAFIVADPGMVKFGYVDRVIHFLKQRRDPVHYEVFSDVEPDPSVATVMKGTELMRKFEPDVIIALGGGSAMDAAKGMWLFYESPETDFFGLKQKFLDIRKRVFKFPDLGKKAKFVAIPTTSGTGSEVTSFSVITDKENDMKYPLADYALTPNVAIIDPEFVLTVPQRVLADSGMDVLTHAIEAYVSNMANDFTDGLCIKAIQLVFKYLPRSYKDSTDREAKEKMHNASTIAGMAFSNAFLGINHSLAHKLGNEFHLAHGRCCAILLPHVIRFNAQKPTKFAAFPKYKHFIADERYAEIAQVLGIAGKTTEESVENLVQAIKKLTQELNMPMSIEKNGVSKEAFEAAVDKLADRAFGDQCTPANPKMPLVSELTEIYRQAFKGI

SEQ ID NO: 89 - protein, 462 aa, Artificial Sequence
  AADHss
MADEQLVQNVVREVVARMQISAPARGMHGVFSDMEEAIEAARTAQQTVRLLPMDQREKIIGAIRRKTRENAEILARMAVNETGMGNVGDKILKHLLVADKVPGTEDISTRAFSGDRGLTLIEMGPFGVIGAITPCTNPSETVLCNTIGMLAGGNTVVFNPHPQAIKTTLFTIQMVNEASLEAGGPDNIACTVDAPTLATSEIMMKSPHIKLLVATGGPGVVTAVLSSGKRAIGAGAGNPPALVDETADIRKAAEDIVNGCTFDNNLPCIAEKEIVAVDSIADELLHYMLTEQGCYQASEEELDRLTKAVMDEKGRLNRKAVGRSARKLLSMIGVEVDANIRCITFFGPKEHPLITTELMMPILGIVRVKDFAEGLETAAWLEHGNKHSAHIHSKNVDRITEYARRLDTTITVKNGPSYAALGFGGESYCTFTIASRTGEGLTSARSFIKSRHCVMTDSLCVR

SEQ ID NO: 90 - protein, 467 aa, Artificial Sequence
  AADHta
MNNTELESLIRTILTEQLTPSATDTPACTASSVALFDDVDSAICAAHAAFLRYQEAPLKTRSAIIAAIRAEIAPCLSELAERAAAETGMGNTADKILKNKAALENTPGIEDLKTTALTGDEGMVLFEYSPFGVVGAVAPSTNPTETIINNSISMLAAGNAIYFSPHPGAKNISLWLIQKMEEIAFKVCGIHNLIVTVKEPTFEATQQMMAHDKIALLAITGGPGIVNMGLKSGKKVIGAGAGNPPCLVDETAEIVKAAQDIVAGASFDYNLPCIAEKSVIAVDCIADQLIQQMREFGAMQITDPQQIAQLREVCIQKGAANKSLVGKSPATILAAAGIPCPAKEPRLIILEVPANDPFVVTEQLMPVLPIVRVDNFEQGLQLALKVEDGLHHTAMMHSQNVSRLNKAAHLMQTSIFVKNGPSYAGIGVGAEGFTTFTIATPTGEGTTSARTFGRLRRCVLTNGFSIR

SEQ ID NO: 91 - protein, 474 aa, Artificial Sequence
  AADHtl
MVDIDLKNVEQIVRTVLASMQTQPQAVQPAAGRRAAPGVFTELDDAVAEASTAQRAIRNLATRVKVVEAIRKAAEAHARELAELAVAETGMGRVEDKFAKNVSQARHTPGVECLAPTALTGDRGLTLIENAAWGVIASVTPSTNPAATIINNAISMISAGNTVVFAPHPAAKKVSQRTVSLLNEASVAAGGPDNVVTTVLNPDIATAQRLFSYPGIHLLTVTGGEAVVEAARKHTDKRLIAAGAGNPPVVVDETADLARAARDIVWGASFDNNIICVDEKEIIVVDRVCDALKTEMARHKAVELTPDQGKRLVDVLLNYVGADGRGTVSRDWVGRDAAKIAAAIGLEVPADTRLLYIETPADHPFAVTELMMPVIPVVRAPDVDAAIDLAVKLEGNCRHTAAMHSRNIDALDRMANAINTSIFVKNGPCLAGLGFGGEGWTTMTISTPTGEGVTSARTFVRLRRCVLVDHFRIV

SEQ ID NO: 92 - protein, 912 aa, Artificial Sequence
  AADHtm
MDTAVAVQKQDIAMSAASKPKSASGPPFDVQAHVDGLVARAIRALAEFQALDQEQVDRIVAKASVAALNQHGVLAKLAVEETGRGLFEDKAVKNMFACENVTSAMKRMKTVGVIHRDNLNGIVEIAEPVGVVAAVTPVTNPTSTAIFKALVCLKTRNPIVFGFHPHAQKCSAEAVRIVRDAAVAAGAPTNCAQWIEVPSIKATGALMNHPDISVILATGGDAMVKAAYSCGKPAIGVGPGNVPAFVEKTADVARAAYDLVLSKSFDYGMVCASEQAAIIEAPVYDQAMAEMQRLHAHVATSDEKRKLEELAFGVVANSENCGSAKLNPAIVGKSASWLAKQAGFSVPQDTSILLVEADHVGYDEPLTREKLCPILAVIRARDADDGIRLSEQMVEQDGLGHSACIHSTDEEVIEKFGRRIKAVRIITNSPTSLGGIGDIYNAFVPSLTLGCGTYGKNSVSNNVQAVNLINVKRIGHRNNNIQWFKVPAKIYFEPNAIRYLADMRRVNRVFIVTDATMSKLGVVDRIRDVLNRRLNMVTMQVVDTIDSEPSISMVEVGAEQMRNFQPDTIVALGGGSAMDAAKVMWLLYEHPEVSFSDVREKCFDVRKRAFTFPDLGEKAQLVCISTTSGTGSEVTPFACITDPKTGYKYQLTDYALMPTVAIVDPTLVNAMPSRLAADSGMDALARATEAYVSVYANDFTDGLAMQAIKLIFENLPASVLKGDAKAREKMHNAGTIAGMASGSAFLGIVHAITHTIGASYRISQGRSNATLLPLGIRYNGRIPTKLTSWPKYEKYVAPQRYQDIAKMLGLPAATPEEGVESYARAVEDLRATLNMEYSFRAQGIEEHDFVANLDEMAFRASDDQSAPANPRLPMVEDLKIIMEAAYYGISFDDIVARRASAQLAKSEVSKKG

SEQ ID NO: 93 - protein, 532 aa, Artificial Sequence
  AADHvs
MNEQEIAHAVENVLSKYTNVTAQNAEPVSYSSNASLENIVSQALAGNMVKQPETQTAPDLNSNIENIVSQILAENQAKPQSVQCQSANHGTTEYLGCFASMEEAISAASHAQVQYRHCTMGDRASFVKGIREVFTQDDVLEKISRMAVEETGMGNYADKLTKNRIAATKTPGIEDLTTSALSGDSGLTLTEFSAYGVIGSITPTTNPTETIINNSIGMLAAGNTVVYSPHPRSRNVSLVAVDLINRKLAELGAPANLVVTVLEPSIDNTNAMMNDPRVNMLVATGGPSIVKTVMSTGKKAIGAGAGNPPAVVDETANIEKAAKDIINGCAFDNNLPCIAEKEVIVVNEVADYLIHCMKKSGAYLLCDKQKIQQLQSLVLNEKGTGPNTSFVGKGARYILDKLNIQVSDDIKVILIETERNHPFVVHELMMPILPVVRVENVDEAIDLAIKVEHGNRHTAIMHSTNVEKLSKMARLIQTTIFVKNGPSYSGIGVGGEGHTTFTIAGPTGEGITSARSFARYRRCVMVEALNIR

SEQ ID NO: 94 - protein, 891 aa, Artificial Sequence
  ADHEec
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 95 - protein, 885 aa, Artificial Sequence
  ADHEpm
MSGLQMFQNLSLYGSLAEIDTSEKLNEAMDKLTAAQEQFREYNQEQVDKIFKAVALAASQNRVAFAKYAHEETQKGVFEDKVIKNEFAADYIYHKYCNDKTAGIIEYDEANGLMEIAEPVGPVVGIAPVTNPTSTIIYKSLIALKTRNCIIFSPHPGAHKASVFVVKVLHQAAVKAGAPENCIQIIFPKMDLTTELLHHQKTRFIWATGGPGLVHASYTSGKPALGGGPGNAPALIDETCDMNEAVGSIVVSKTFDCGMICATENAVVVVESVYENFVATMKKRGAYFMTPEETKKASNLLFGEGMRLNAKAVGQTAKTLAEMAGFEVPENTVVLCGEASEVKFEEPMAHEKLTTILGIYKAKDFDDGVRLCKELVTFGGKGHTAVLYTNQNNKDRIEKYQNEVPAFHILVDMPSSLGCIGDMYNFRLAPALTITCGTMGGGSSSDNIGPKHLLNIKRVGMRRENMLWFKIPKSVYFKRAILSEALSDLRDTHKRAIIITDRTMTMLGQTDKIIKACEGHGMVCTVYDKVVPDPTIKCIMEGVNEMNVFKPDLAIALGGGSAMDAAKMMRLFYEYPDQDLQDIATRFVDIRKRVVGCPKLGRLIKTLVCIPTTSGTGAEVTPFAVVTSEEGRKYPLVDYELTPDMAIVDPEFAVGMPKRLTSWTGIDALTHAIESYVSIMATDFTRPYSLRAVGLIFESLSLAYNNGKDIEAREKMHNASAIAGMAFANAFLGCCHSVAHQLGSVYHIPHGLANALMLSHIIKYNATDSPVKMGTFPQYKYPQAMRHYAEIAELLLPPTQVVKMTDVDKVQYLIDRVEQLKADVGIPKSIKETGMVTEEDFFNKVDQVAIMAFDDQCTGANPRYPLVSELKQLMIDAWNGVVPKL

SEQ ID NO: 96 - protein, 459 aa, Artificial Sequence
  EUTEdz
MEHSVIEPTVPMPLPAMFDAPSGIFSSLDDAVQAATLAQQQLSSVELRQQVIKAIRVAGERYAQVLAEMAVAETGMGRVVDKYIKNVSQARHTPGIECLSAEVLTGDNGLTLIENAPWGVVASVTPSTNPAATVINNAISMIAAGNSVVFAPHPSAKNVSLRTISLLNKAIVATGGPENLLVSVANPNIETAQRLFRYPGIGLLVVTGGEAVVEAARKHTDKRLIAAGAGNPPVVVDETADIPKAARAIVKGASFDNNIICADEKVLIVVDRVADALLAEMQRNNAVLLTPEQTERLLPALLSDIDEQGKGRVNRDYVGRDAAKLAAAIGLEVSEHTRLLLAETDADHPFAVTELMMPVLPVIRVKNVDDAIALAVKLESGCRHTAAMHSTNIRNLNRMANAINTSIFVKNGPCIAGLGLGGEGWTSMTISTPTGEGVTSARTFVRLRRCVLVDMFRIA

SEQ ID NO: 97 - protein, 467 aa, Artificial Sequence
  EUTEec
MNQQDIEQVVKAVLLKMQSSDTPPAAVHEMGVFASLDDAVAAAKVAQQGLKSVAMRQLAIAAIREAGEKHARDLAELAVSETGMGRVEDKFAKNVAQARGTPGVECLSPQVLTGDNGLTLIENAPWGVVASVTPSTNPAATLINNAISLIAAGNSVIFAPHPAAKKVSQRAITLLNQAIVAAGGPENLLVTVANPDIETAQRLFKFPGIGLLVVTGGEAVVEAARKHTNKRLIAAGAGNPPVVVDETADLARAAQSIVKGASFDNNIICADEKVLIVVDSVADELMRLMEGQHAVKLTAEQAQQLQPVLLKNIDERGKGTVSRDWVGRDAAKIAAAIGLNVPQETRLLFVETTAEHPFAVTELMMPVLPVVRVANVADAIALAVKLEGGCHHTAAMHSRNIENMNQMANAIDTSIFVKNGPCIAGLGLGGEGWTTMTITTPTGEGVTSARTFVRLRRCVLVDAFRIV

SEQ ID NO: 98 - protein, 469 aa, Artificial Sequence
  LIN1129li
MESLELEQLVKKVLLEKLAEQKEVPTKTTTQGAKSGVFDTVDEAVQAAVIAQNCYKEKSLEERRNVVKAIREALYPEIETIATRAVAETGMGNVTDKILKNTLAIEKTPGVEDLYTEVATGDNGMTLYELSPYGVIGAVAPSTNPTETLICNSIGMLAAGNAVFYSPHPGAKNISLWLIEKLNTIVRDSCGIDNLIVTVAKPSIQAAQEMMNHPKVPLLVITGGPGVVLQAMQSGKKVIGAGAGNPPSIVDETANIEKAAADIVDGASFDHNILCIAEKSVVAVDSIADFLLFQMEKNGALHVTNPSDIQKLEKVAVTDKGVTNKKLVGKSATEILKEAGIACDFTPRLIIVETEKSHPFATVELLMPIVPVVRVPDFDEALEVAIELEQGLHHTATMHSQNISRLNKAARDMQTSIFVKNGPSFAGLGFRGEGSTTFTIATPTGEGTTTARHFARRRRCVLTDGFSIR

SEQ ID NO: 99 - protein, 2233 aa, Artificial Sequence
  ACC1sc_S659A
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLADGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 100 - protein, 2233 aa, Artificial Sequence
  ACC1sc_S659A/S1157A
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLADGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVAVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 101 - protein, 2233 aa, Artificial Sequence
  ACC1sc_S1157A
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVAVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 102 - protein, 2248 aa, Artificial Sequence; identical to SEQ ID NO: 1
  ACC1ke

SEQ ID NO: 103 - protein, 2216 aa, Artificial Sequence
  ACC1mc
MVEHKSLPGHFLGGNSLESAPQGPVKDFVQAHEGHTVISKVLIANNGMAAMKEIRSVRKWAYETFGNERAIEFTVMATPEDLKANAEYIRMADNFVEVPGGSNNNNYANVELIVDVAERTAVHAVWAGWGHASENPRLPEMLAKSKHKCLFIGPPASAMRSLGDKISSTIVAQSAQVPTMGWSGDGITETEFDAAGHVIVPDNAYNEACVKTAEQGLKAAEKIGFPVMIKASEGGGGKGIRMVKDGSNFAQLFAQVQGEIPGSPIFIMKLAGNARHLEVQLLADQYGNAISLFGRDCSVQRRHQKIIEEAPVTIAKPDVFEQMEKAAVRLGKLVGYVSAGTVEYLYSHHDDQFYFLELNPRLQVEHPTTEMVSGVNLPAAQLQIAMGIPLHRIRDIRVLYGVQPNSASEIDFGFEHPTSLTSHRRPTPKGHVIACRITAENPDAGFKPSSGIMQELNFRSSTNVWGYFSVVSAGGLHEYADSQFGHIFAYGENRQQARKNMVIALKELSIRADFRSTVEYIIRLLETPDFEENTINTGWLDMLISKKLTAERPDTMLAVFCGAVTKAHMASLDCFQQYKQSLEKGQVPSKGSLKTVFTVDFIYEEVRYNFTVTQSAPGIYTLYLNGTKTQVGIRDLSDGGLLISIDGKSHTTYSRDEVQATRMMVDGKTCLLEKESDPTQLRSPSPGKLVNLLVENGDHLNAGDAYAEIEVMKMYMPLIATEDGHVQFIKQAGATLEAGDIIGILSLDDPSRVKHALPFNGTVPAFGAPHITGDKPVQRFNATKLTLQHILQGYDNQALVQTVVKDFADILNNPDLPYSELNSVLSALSGRIPQRLEASIHKLADESKAANQEFPAAQFEKLVEDFAREHITLQSEATAYKNSVAPLSSIFARYRNGLTEHAYSNYVELMEAYYDVEILFNQQREEEVILSLRDQHKDDLDKVLAVTLSHAKVNIKNNVILMLLDLINPVSTGSALDKYFTPILKRLSEIESRATQKVTLKARELLILCQLPSYEERQAQMYQILKNSVTESVYGGGSEYRTPSYDAFKDLIDTKFNVFDVLPHFFYHADPYIALAAIEVYCRRSYHAYKILDVAYNLEHKPYVVAWKFLLQTAANGIDSNKRIASYSDLTFLLNKTEEEPIRTGAMTACNSLADLQAELPRILTAFEEEPLPPMLQRNAAPKEERMENILNIAVRADEDMDDTAFRTKICEMITANADAFRQAHLRRLSVVVCRDNQWPDYYTFRERENYQEDETIRHIEPAMAYQLELARLSNFDIKPCFIENRQMHVYYAVAKENPSDCRFFIRALVRPGRVKSSMRTADYLISESDRLLTDILDTLEIVSHEYKNSDCNHLFINFIPTFAIEADDVEHALKDFVDRHGKRLWKLRVTGAEIRFNVQSKKPDAPIIPMRFTVDNVSGFILKVEVYQEVKTEKSGWILKSVNKIPGAMHMQPLSTPYPTKEWLQPRRYKAHLMGTTYVYDFPELFRQSVQNQWTQAIKRNPLLKQPSHLVEAKELVLDEDDVLQEIDRAPGTNTVGMVAWIMTIRTPEYPSGRRIIAIANDITFKIGSFGVAEDQVFYKASELARALGIPRIYLSANSGARIGLAEELISQFRAAWKDASNPTAGFNYLYLTPAEYDTLVQQGDAKSVLVEEIQDEGETRLRITDVIGHTDGLGVENLKGSGLIAGATSRAYDDIFTITLVTCRSVGIGAYLVRLGQRTVQNEGQPIILTGAPALNKVLGREVYTSNLQLGGTQIMYKNGVSHLTAENDLEGIAKIVQWLSFVPDVRNAPVSMRLGVDPIDRDIEYTPPKGPSDPRFFLAGKSENGKWLSGFFDQDSFIETLSGWARTVVVGRARLGGIPMGVVSVETRTVENIVPADPANSDSTEQVFMEAGGVWFPNSAYKTAQAINDFNKGEQLPLMIFANWRGFSGGQRDMYNEVLKYGAQIVDALSNYKQPVFVYIIPNGELRGGAWVVVDPTINKDMMEMYADNNARGGVLEPEGIVEIKYRKPALLATMERLDATYASLKKQLAEEGKSDEEKAALKVQIEAREQELLPVYQQISIQFADLHDRAGRMKAKGVIRKALDWRRARHYFYWRVRRRLCEEYTFRKIVAATSAAPMSREQMLDLVKQWFTSDNETASFEDADELVSEWFEKRASVIDQRISKLKSDATKEQVVSLGNADQEAVIEGFTQLIENLSEDQRAEILRKLNSRF

SEQ ID NO: 104 - protein, 2233 aa, Artificial Sequence
  ACC1sc
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 105 - protein, 2266 aa, Artificial Sequence
  ACCyl
MRLQLRTLTRRFFSMASGSSTPDVAPLVDPNIHKGLASHFFGLNSVHTAKPSKVKEFVASHGGHTVINKVLIANNGIAAVKEIRSVRKWAYETFGDERAISFTVMATPEDLAANADYIRMADQYVEVPGGTNNNNYANVELIVDVAERFGVDAVWAGWGHASENPLLPESLAASPRKIVFIGPPGAAMRSLGDKISSTIVAQHAKVPCIPWSGTGVDEVVVDKSTNLVSVSEEVYTKGCTTGPKQGLEKAKQIGFPVMIKASEGGGGKGIRKVEREEDFEAAYHQVEGEIPGSPIFIMQLAGNARHLEVQLLADQYGNNISLFGRDCSVQRRHQKIIEEAPVTVAGQQTFTAMEKAAVRLGKLVGYVSAGTVEYLYSHEDDKFYFLELNPRLQVEHPTTEMVTGVNLPAAQLQIAMGIPLDRIKDIRLFYGVNPHTTTPIDFDFSGEDADKTQRRPVPRGHTTACRITSEDPGEGFKPSGGTMHELNFRSSSNVWGYFSVGNQGGIHSFSDSQFGHIFAFGENRSASRKHMVVALKELSIRGDFRTTVEYLIKLLETPDFEDNTITTGWLDELISNKLTAERPDSFLAVVCGAATKAHRASEDSIATYMASLEKGQVPARDILKTLFPVDFIYEGQRYKFTATRSSEDSYTLFINGSRCDIGVRPLSDGGILCLVGGRSHNVYWKEEVGATRLSVDSKTCLLEVENDPTQLRSPSPGKLVKFLVENGDHVRANQPYAEIEVMKMYMTLTAQEDGIVQLMKQPGSTIEAGDILGILALDDPSKVKHAKPFEGQLPELGPPTLSGNKPHQRYEHCQNVLHNILLGFDNQVVMKSTLQEMVGLLRNPELPYLQWAHQVSSLHTRMSAKLDATLAGLIDKAKQRGGEFPAKQLLRALEKEASSGEVDALFQQTLAPLFDLAREYQDGLAIHELQVAAGLLQAYYDSEARFCGPNVRDEDVILKLREENRDSLRKVVMAQLSHSRVGAKNNLVLALLDEYKVADQAGTDSPASNVHVAKYLRPVLRKIVELESRASAKVSLKAREILIQCALPSLKERTDQLEHILRSSVVESRYGEVGLEHRTPRADILKEVVDSKYIVFDVLAQFFAHDDPWIVLAALELYIRRACKAYSILDINYHQDSDLPPVISWRFRLPTMSSALYNSVVSSGSKTPTSPSVSRADSVSDFSYTVERDSAPARTGAIVAVPHLDDLEDALTRVLENLPKRGAGLAISVGASNKSAAASARDAAAAAASSVDTGLSNICNVMIGRVDESDDDDTLIARISQVIEDFKEDFEACSLRRITFSFGNSRGTYPKYFTFRGPAYEEDPTIRHIEPALAFQLELARLSNFDIKPVHTDNRNIHVYEATGKNAASDKRFFTRGIVRPGRLRENIPTSEYLISEADRLMSDILDALEVIGTTNSDLNHIFINFSAVFALKPEEVEAAFGGFLERFGRRLWRLRVTGAEIRMMVSDPETGSAFPLRAMINNVSGYVVQSELYAEAKNDKGQWIFKSLGKPGSMHMRSINTPYPTKEWLQPKRYKAHLMGTTYCYDFPELFRQSIESDWKKYDGKAPDDLMTCNELILDEDSGELQEVNREPGANNVGMVAWKFEAKTPEYPRGRSFIVVANDITFQIGSFGPAEDQFFFKVTELARKLGIPRIYLSANSGARIGIADELVGKYKVAWNDETDPSKGFKYLYFTPESLATLKPDTVVTTEIEEEGPNGVEKRHVIDYIVGEKDGLGVECLRGSGLIAGATSRAYKDIFTLTLVTCRSVGIGAYLVRLGQRAIQIEGQPIILTGAPAINKLLGREVYSSNLQLGGTQIMYNNGVSHLTARDDLNGVHKIMQWLSYIPASRGLPVPVLPHKTDVWDRDVTFQPVRGEQYDVRWLISGRTLEDGAFESGLFDKDSFQETLSGWAKGVVVGRARLGGIPFGVIGVETATVDNTTPADPANPDSIEMSTSEAGQVWYPNSAFKTSQAINDFNHGEALPLMILANWRGFSGGQRDMYNEVLKYGSFIVDALVDYKQPIMVYIPPTGELRGGSWVVVDPTINSDMMEMYADVESRGGVLEPEGMVGIKYRRDKLLDTMARLDPEYSSLKKQLEESPDSEELKVKLSVREKSLMPIYQQISVQFADLHDRAGRMEAKGVIREALVWKDARRFFFWRIRRRLVEEYLITKINSILPSCTRLECLARIKSWKPATLDQGSDRGVAEWFDENSDAVSARLSELKKDASAQSFASQLRKDRQGTLQGMKQALASLSEAERAELLKGL

SEQ ID NO: 106 - protein, 2243 aa, Artificial Sequence; identical to SEQ ID NO: 2
  ACC1ch

SEQ ID NO: 107 - protein, 1229 aa, Artificial Sequence
  HPDH-MCRbs
MTAGKGKGAKVDPAGGKAATGRLAGKVALVTGAAGNLGGAIIRRFIAEGATLVMTGRTKERLAAAKQALLDETGVEEARVFTVILDGADPDSVRAGIDQVRAALGRIDVLVNNAGSAGPRQTLENVPLTRAEMEANGDSETVADAMRNLLGVSWNLTRAAAPIMPVGASVVNISTIFSHTRYYGRTAYVVPKAALNALSQELAKELGASGIRVNTVFPGPIESERIRTVFAAMDALQGEPENSTANHFMGRMTLERAIGDAPKRKTLPVPGDIADACLFLASDESAALNGNEIDVTHGMQVRKDSRSTYMTRPSMRSLDGAGLTVLIAAGEAWEDALDMAKIQAACGARVLLGMTRQVDVAQAEARVKAQGAEEGLTIMRFNRAEPDGMEAAIRAYSDAHGAIHSAIVLPVKPAGHFGDSLVEASDAEVDALIDIELTGAIAVARTLRRYWKTCSDLMQDPRFVFMSGPSDGKGNKAGRILAAAIAQLITIWRDESRVDFAQGRQKRAAWGNQIVRYTNEEDENTRFAAGHATRIVFKEQKITETSLYLPANIGEETGARRAMLGFAENITGLHLGKVAMITGGSAGIGGQVARLLALAGAKVMMVARRASELEAARERIVGELQDVGFSGVERRVKIMADVDVSDFDSLRRAADATMAEFGRIDYLINNAGVAGAEDMVIDMSLDMWRWTLDANLISNYLLMHYVVPIMKRQGSGYILNVSSYFGGEKFLAVAYPNRADYAVSKAGQRAMVESFSRFLGPEIQVNAIAPGPVDGDRLSGTGGKPGLFLRRARLILENKRLNAIYAAVIESIREGAEVTHVLGRLARNDTGYLSHDRSTPDPLRLLCLELAREGDGICTWDRYLLTPDIAGRLLMRLASAGYLLAHEEWQQRSASAEGRTGWLLALPPDDMPYLPQERIGKEADKVGRGVLSQLHLGAMPKESEVAQATVFYLADRAVSGETFMPSGGLSVERSYTEREMFGSPKQERLEQMKGKTVWVIGEHLADYIAETANHLIGGLGVARLVLLTRSEAGGASVLALLDPEIAERVTVRLCGADVESAMDQALTDFGRPTTVVSTPMAGLPDRLFEDGAMLEPEEFRTLCEENLTQHFRVSRKASLYDGCQLVLVSPDVPFGQSGPAFALANFVKTTLHAFTATLAVENERLVHDVPTNQINLTRRVRSEEPRNAVEHQEELKRFARAVLLVGAPLPDAQDSRYRARIYRGTSMTV

SEQ ID NO: 108 - protein, 1220 aa, Artificial Sequence
  HPDH-MCRca
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 109 - protein, 1219 aa, Artificial Sequence
  HPDH-MCRcag
MSVTGRLAGKIALITGGAGNIGSEMTRRFLAEGATVIISGRNSAKLAALAERLRSEAGVPAKRIDLEVMDGSDPAAVRAGVAAIIGRHGHIDILVNNAGSTGAQRRLAEIPLNETDRDLDDEEALSTSVANLLGMAWHLMRILSPHMPPGSAIINISTIFSRAEYYGRIPYVVPKAALNTLTQIAARELGIRGIRVNTIFPGPIESERIQTVFQRMDQLKGRPEGDTASQFLATMRLYRANDQGQLERRFPTICDVADAAVFLASDEAAALTGETIEVTHGMELPTSSETSLLARTDLRTIDANGRTTLICAGDQIEEVMALTGMLRTCGSEVIIGFRSEAALAQFEQAIGESRRLAGESFIPPIALPIDLRNPSTIDALFDWAGENTGGIHAAVILPASGREPATQVIDIDDAHVQAFLNDEIVGSIIIASRLARYWQAQRIAPGARAREPRVIFLSNGASTAGNPYGRIQSAAIEQLIRVWRHEAALDYERATAAGERVLPAVWASQIVRFANRSLEGLEFACAWTAQLLHSQRRINEITLTIPADISATTGARSASVGWAESLIGLHLGKVALITGGSAGIGGQIGRLLALSGARVMLAARDPHKLEQIQATIRAELAEVGYTDVEERVQIAPGCDVSSEEQLVDLVERTLAAFGTVDYLINNAGIAGVEEMVIDMPVEGWRNTLYANLISNYSLMRKLAPLMKKQGSGYVLNVSSYFGGEKDAAIPYPNRADYAVSKAGQRAMAEVFARFLGPEIQINAIAPGPVEGDRLRGTGERPGLFARRARLILENKRLNELHAALITAARTDNRPMRELVELLLPNDVAALAQHPAAPDVLRTLAKRFQSEGDPAASSSSFLLNRSIAAKLLARLINGGYDLPADIFANLAVPPDPFFTRAQIDREARKVRDGIMGMLYLQRMPTEFDVAMATVYYLADRNVSGETFHPSGGLRYERTPTGGELFGLPAPERLAELVGSTVYLIGEHLTEHLNLLARAYLERYGARQVVMIVETEAGAEKMRHLLHDHVEAGRLPIIVAGDQIEAAIDQAIANYGRPGPVVCTPFRPLPSAPLVGRKDSDWSTVLSEAEFAELCEHQLTHHFRVARKIALSDGASLALVTPETTATSSTEQFALANFVKTTLHAFTATIGVESERTAQRILINQVDLTRRARAEEPRDPRERQQELERFIEAVLLVTAPLPPEADTRYAGRIHRGRAITV

SEQ ID NO: 110 - protein, 1231 aa, Artificial Sequence
  HPDH-MCRct
MRRTKPECLRRNESTMRLNGKVALITGAAGGIGSVVTRMYLREGARVAISSRSLERAEQFRAALMAEGFSGDDILPVAFASTDLAGMQTAIEAIAARWGGLDVLINNAGSAGAKQPLFRIPFTSEDLAQLAAEGFTETETMRESAANLLGMPWHLTRLALPYLRVGASIINVSTIFSRTNYYGRIPYVVPKSALNALSLGLAKQLGTTDRAVRVNTVFPGPIDSDRIRTVFGAMDRLKGVPEGTTAQEFFDIMILARARGGEAPTKCYPTQADVAHVILFLGSDESAAISGHNFEITHGMQVKAQSRTKLTAWPDQRLIDLSRRVVLIVGGEQVHDAVTIAASQQSYGASVILTFRQPEAVNTAKAQLESRGLNHSIAVTWLDPLRRESVTSVFDLIRERYHRLDTVIVFPAHAAGHYGPELIPDEPERIRQFTDEAILGTTAFAAQLSRFLLAFDAENELQEPVNVLFVTNEHDGATNAFEDIYRAAVEQLLRVWRHEDELQVAAGTRRFAVRTNQIVRYANAEPDNLKFTADWLATLANRVRIFDELNLYVPENIQRTTGKTELPRDIARTLLGLHIGKVAVITGGSAGIGGAIGHYLALSGAKVVLAARDAERLAALKREIVAELFAVGYPQPETRVETLANIDVADEEALGRLVKFALDKFGRIDFLINNAGIAGAEEMVVDLPLAAWRHTLKANLLSNYSLIYKIAPLMKKQGAGYILNVSSYFGGEKYVAVAYPNRSDYAVSKAGQRALAEILARHLGPEIQINALSPGPVEGKRLRGEGSRPGLYARRARLILENKRLNDIHDAVIRAWREGEAVKSTLGALAHNHFEDVLAAGPPEPVRRLITHLRAAAVNEGHSDSHYLMTRKIAEKLLHRLFEGGYLTSVEDREAFTLAFLRELPEPPDPFFDPKEIDREAERVQSGILTMLNLRRMPTEEEIAIATVFYLSDPNISGETLHPSGGLKFDRTVTEGEFYGLPRNEHLMELRRKNVLLIGDYLEEELRWLVGAFAIQLVVRNCIILTKTAERADSLRHYFSAQRLNNLHIFSAGANVEAAMDDLIRRFGHLDVVVSTPFDPLPLKPLAATDDWRGVLNEKDFEQLVETHITHHFRVAKKAALQDKSQIVLVTPKTSRNSSREEFALALFVKTTLHALTATLAVECERFTHHPTVNQVDLTRRARVEEPRNEREEREELERFVDAVLLAAAPAPEPEQSRYLSRIHRGNAITV

SEQ ID NO: 111 - protein, 1216 aa, Artificial Sequence
  HPDH-MCRgb
MNDMSDIPQDLLTQSIAGRRLDNKCIILTGAAGSIGSFITRQLLREGARVMLTGRDQSKLDDFIGDLVSEGFEETFMVSATGDCADPEVCREIVAKTVAAFGPIDVLVNNAGAAGPKFTLRDIPFTEAEQRAADSDQTMFDSAMNLLGAPWNMARAAAPHMSAGASIINVSTIFSRTHYYGRIPYVVPKSGLNALGKGLALELGEKQGIRVNTLFPGPIESERIESVFARMDELQGVEPGSTGKEFRDLMITTRTSDGGLEYKYPTPTDVASGIVWLASDESSALSGHHIEVTNGMQVPAQSRSQLVSWPDKRLEDLSGQVVLILGGDDYQEAVTFAERQIQSGARVMLAFRNLNTVGHARSLVQSRNLGDVQLSHLDPLRRESVDRSMQLIADHFGRLDGVILLPQKPNGEYGYSLTTANDEDVANFVRDEVVAPVAFASAFARNMDQLFAEGEPPAIVYVTNPSDRHGNLMNEIIRASVEALIRGWRHEDETLANTGELPWAVQPNQMVRYDTEDREALTFAADWAATLTNRVRKMDSINLWLPRSIKRSTGKSSMPSSISRVLPGLHKGRTAVITGGSLGIGLQLGRFLAIAGARVLLSARSEGKLAEARDEIVDELRNIGYPRPESRVTILGGIDVGDPDALDRLHDHAVAELGHVDFLINNAGISGAEEMVVDMTRADWDRTMEANLISNYSLIRKFSPAMKAGGKGSILNVSSYFGGEKYVAVAYPNRADYAVSKAGQRVLAEILSRHLGPEIQINALAPGPVDGARLRGSAEAPGLFDRRGRLVLENKRLNEVHKAILAGMSSGFDADGVMSLASNAVDSIDIDSLPKPVARLVLKIRDSGGMGNSSHYLMHMGIAAKLMTRLVRAGILSDEQREQFLGTFIDAPAPFFDFSETSKQAEQIETGILNRLHLHKMPTDEQVGLSTVFHLADDIVSGETFHPSGGLKFDRSVTEGELLLPPNETEVAKLKGKRIVLIGDSMRNELTHIANGFLAQNVEKLWVLTKTEDSANAMTHSVDNPHGIDIECRAIGDDLESSLDDILRNDGGYDVVVSSPFERLPLNALAANANEPWDRVLSDHEFRKLVHDQLTHHFRVARTSALVPNCQIVLITPDTSLASTREEFALALFVKNSLHAFTVTLGVEGERLPTVPAINQVQLTRRAHTEEPSNDQELEEEMTRLVHAVLQCSVPAPAPSDSRYLSKIFRGNAVTV

SEQ ID NO: 112 - protein, 1221 aa, Artificial Sequence
  HPDH-MCRot
MFMTRLNDKIALITGGAGTIGEVITRRYLEEGATVVMAGRNRDKLDRYRERLITEFHALPERVMVVRMDGSSNAEVRMGIAAVVAHFGRIDILVNNAGSAGARQRLPAIPLLRSELQADETETLADSIGNLIGITWNLIRAAAPFMPAGSSVINISTIFARTDYYGRIPYVVPKAALHALTLAAATELGERGIRVNQINPGPIDSDRIRTVFRRMDELKGVPEQSTADGFFQMMRLRRPNAEGDLVKGFPKTLDVANVAVFLGSAESAALSGETLDVTHGMAVPTESRTTLTSRPGLRAVDGSGHTTLICVGDQIEEAAALTGVLRACGAEVVIGFRSRAAIARFDHLIERGRHLPSQEHVAPVLLYLNPTEPESIDQALRWMATNLDLPTSVIILPAQRQPLPPSVVRASDEEVAYFLRDELSGMIVLASRLARFWQQATLAPGNAPIQPRVLFMTNPDDGQGNLYAEILRAGVEQLCRVWRHESQLDYTRLAQMDAHPPHIRPVWANQLVRFANNEQENLEYCCAWVAKILLSERTIEELNLYLPRQIGSTTGSRQPSFGWAENLIGLHLGKTALITGGSAGIGSQIARLLALSGARVMLCARDERKLIQMRDMIIAELTEVGYNQVESRVQICAGCDVGEEEQLEIAVQRTLDLFGHVDYLINNAGIAGAEEMVLDLPLEAWQRTLRTNLISNYSLIRKLAPQMKSRGSGYILNVSSYFGGEKYAAIPYPNRADYAVSKAGQRALGEALARLLGPEVQINAMAPGPVEGERLRGSGDRPGLFLRRGRLILENKRLNDLHATLIAAERETQVGMRDLLARLLHNDVCALIDDPAAPTHLRALAERIWEQSDPNSYARAFFMNANIATKLLARLFNADQIDAQTFHTSQPNLPPEPFFARTQIDREARRVRDGVMSMLYLQRMPTEFDVALATVYYLNDRSVSGETFHPSGGLRHERTPTGAELYGSPAPQRLASLAGSTVYLIGESMAAHLEALARAYIERYAATRVVLICATPAGVERFSHHLADHLASGALAILSAEEGIEAALSEALRRFGPPGPVVSTPFQPLPSQPLIGRNDSDWSTVLDVAGFSAMCEQQLTHHFRVTRKLSLVAGVSLVLVTPETDSHSSTEQFALANFVKTTLHAFTATVGVECERTAHRILVNQVDLGRQARAEEPRSPAEQAQEMERFIDAIMLTTAPIPAEEDNRYTGRIYRGRAITV

SEQ ID NO: 113 - protein, 1229 aa, Artificial Sequence
  HPDH-MCRrc
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRIAEINLYLPEEIVGTIGVHNPGFGWAESLFGLHMGKVALITGGSAGIGGQIGRLLALSGAHVMLAARNADQLEQMRASIVREVRDASYPDAESRVAIFPGSDVSDIDGLERLVNHTVRVFGKVDYLINNAGIAGAEEMVIDMPVDAWRHTLRANLISNYALLRRLAPQMKAAGGAYVLNVSSYFGGEKYVAIPYPNRSDYAVSKAGQRAMVESLARFLGPEIQINAIAPGPVEGERLKGAGSRPGLFMRRARLILENKRLNEVFAALLAARHEGATIADLLPDLFANDIQSIANSAAMPAPLRRLATMLRETSDAGGSAQSYLMNATIARKLLNRLENGGYITLHDRRALTVEPPEPFFTEAQIEREAIKVRDGILGMLHLQRMPTEFDVALATVFYLADRNVTGETFHPSGGLRFERTVTEGELFGKPGQQRLERLKGSVVYLIGEHLRQHLVLLARTFLDEIHVARVVLLTETTQAATDLAAELSDYEAAGRFVVIPTCGDIEGGIDRAMAEYGRPGPVISTPFRPLPDRALSARNGDWSSVLTTAEFEELVEQQITHHFRVARKAGLIEGANVTLVTPPTSARSTSEEFALANFVKTTLHALTATAGAESERTVPHVPVNQVDLTRRARSEEPRTPSEEEEELQRFVNAVLLTSAPLPTPLESRYRARIYRGNAITV

SEQ ID NO: 114 - protein, 1204 aa, Artificial Sequence
  HPDH-MCRsl
MNAMGKTETQGRLAGKVALITGAAGNLGGSIVRRYLAEGATVVMSGRDAARTQAALDAAVADVGGTASIVTMDGANIESVRAGIADVVARHGRIDVLVNNAGSAGPKQVLGDLPLLPEELEGTPDSETVGDAARNIMVVAWNLVRAAASAMGEGGSIINVSTIFSRTDYFGRAAYTVPKAALNILSKGIARELGTRGIRVNQLYPGPIASERIRTVFAAMDKLKGDDAGSTANHFFNLMALERSVGEDAKAKTFPTPADIANTCVFLGSDESAAFAAHDFEVTHGMAVPLESKSEFLHRPDLRAIDGDGHGILISAGNQLDDALAMAGLFAAQGSKVLLGFHAQAALDDAAERLPAGVKAVRFPRHDHMAMDAELARFTAHVAAIDGAIILPTRGPGYFHGALNEASDAAVERFVDDELEGAIAVARTLDRYWQQGQDLPGDPRVLFITNPDDGAGNGWADVGRAAIEELLRVWRDEARVAATQGKTPRPVWGNQIVRFGNNEPENRDFAAGHAARLLLGGRQIEPINLYIPASITKATGARRALAGTAENITGLHLGKVALITGGSAGIGGALARLLALAGAKVMMVARRESELDAARERIVGELQDIGFAGVERRVLTLAGIDVADMKSLKHAVDETVRAFGRIDYLINNAGVSGAEEMAVDMGVENFRHTQFANLISNYALMHMVVPMMRKQGSGYILNVSSYFGGEKYLAVSYPNRTDYAVSKSGQRAMVESMARHLGPEIQINAIAPGPVDGDRLAGLGGKPGLFERRGRLILENKRLNAVHSAVIKSVRAGGSVAQILFRLSRNDSVQLSHDKSNPQPLRDLALACAREGDESCCWDRFILTPVLAAKLLKRLRLGGWLIGTDWQSRDESDWLLRVPPDDMPWLPVAQIGREAAKVRGGVLSQLHLGKMPTETEVAQATVFFLADRAVSGETFMPSGGLNVERSATERELFGSPKAERLAQMGGKTVWLVGEHLADYLGAAAQGFLNCDVARVVLITASAAGATAIKGHIGSGADRVESLLIDGEIETALDAALATWGHPTTIVSTPLKALPDQLFDADNPLDGDGFADVVEHNLTHHFRIARKVSLFDECQLVLVSPDVPMGEGAKGAFALANFVKTTLHAFTATIAVENERLVHEVAVNQINLTRRVRSEEPKNAAEHEEEVRRFARAVLLAGAPLPDAEDSRYRSRIYRGMSLTV

SEQ ID NO: 115 - protein, 1220 aa, Artificial Sequence
  HPDH-MCRca_(Variant_3)
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLADIQEDKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 116 - protein, 1220 aa, Artificial Sequence
  HPDH-MCRca_(Variant_6)
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLADVDTRKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERGGLFGRRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLARAYLERYGARQVVMIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 117 - protein, 258 aa, Artificial Sequence
  BDHcm
MVNLQGKTALVTGSTSGIGLGIAEALGRAGANIVLNGFGDVDAALATIAATGAQSAHHPADMRKPDEIEAMIAMARERFGTVDVLVNNAGIQHVAQVEDFPAQKWDDILAINLTSSFHTTRHVIPAMRARNWGRIVNIASVHGLVGSAGKSAYVAAKHGLVGLTKVTALETAGTGITCNAICPGFVLTPLVAAQIDAIAKRDGISMEAARARLLSDKQPSGQFVTPEQLGNLVLMLCSPFGDQVRGAAWAMDGGWTAQ

SEQ ID NO: 118 - protein, 256 aa, Artificial Sequence
  BDHkp
MNLHGKTALVTGSTSGIGLGIAKVLAQAGAQLVLNGFGDSSHARAEVAALGKIPGYHDADLRDVGQIEAMMHYAESTFGGVDIVINNAGIQHVAPVEQFPVDKWNDILAINLSSVFHTTRLALPGMRQRNWGRIINIASVHGLVASKEKSAYVAAKHAVVGLTKTVALETARSGITCNAICPGWVLTPLVQQQIDKRIAEGVDPEQASAQLLAEKQPSGEFVTPQQLGEMALFLCSDAAAQVRGAAWNMDGGWVAQ

SEQ ID NO: 119 - protein, 370 aa, Artificial Sequence
  HBDHos
MQLFKLKTRLSKFDHFADFAREFKLSEHDLVITNEFLYEPFMKSLNLPCHFIMQEKFGLGEPSDKMMNTILKEVKGVGFDRVIAVGGGTVIDISKLFVLKGVEDVTEAFERKIPIVKEKQLVILPTTCGTGSEVTNISIAEITSKHTKMGLADDAIVADDAVLVPELLKGLPFKFYACSAIDALVHATESYVSPKSNPYTRLYCRAAIEIIIDVFQGIAANGPEYRFERLGDMLMASNYAGIAFGNTGVGAVHALSYPLGGSYHVPHGESNYQFFTEVFKLYNAKNPSGDIARLNDLLCVQLGVNENPYPVLDELLGKLIPKNKLRVYGMKPEEIQGFTSSVLQTQQRLLANNYVSLSEEEIREIYKVLY

SEQ ID NO: 120 - protein, 378 aa, Artificial Sequence
  HBDHps
MAFIYYVTQIQFEFGAVKLLKQECERVGITRPLIVTDPGVKAAGILQKALDALPGIAVTVFDQTPSNPTEAAVRAAAALYKAGGCDGLIAVGGGSAIDCAKGVAIAATHEGPLTTYATIEGGSPKISDRVAPLIAVPTTSGTGSEVARGAIIIVDDHRKLGFHSWHLVPKTAICDPELTLGLPAMLTAATGMDAIAHCMETFMSPAFNPPADGIGLDGLERGWSHIERATRDGSDREARLNLMSASMQGAMAFQKGLGCVHSLSHSLGGVDPRLHHGTLNAMFLPAVVRFNASAESVQKERRLDRMARAMGLRSGSDIPDAIKDMNARLGLPTGLAAMGVQRDWFDRIIVGALADHCHKTNPRLASPEEYREMLETSL

SEQ ID NO: 121 - protein, 288 aa, Artificial Sequence
  HIBADHas
MQTIGFIGLGVMGKSMARHLLRAGYSLVVYTRTKQKAEDILAEGALWKETVKDVAKAADVVMTMVGEPQDVEYVYFGDDGILAHAKRGTYVIDFTTSKPSLAVRIHEAAKEKGIFVLDAPVSGGDIGARDGTLSIMVGGDKEAFSACMPLLSHLGKNIVWQGEAGAGQHTKMCNQIAIATNMIGVCEALVYAEKAGLDPERVLRSISQGAASSWSLSNLAPRMLAGDFAPGFYVKHFIKDMGIALAEAETLGLSLPGLKLAKQLYESLAERGEEQSGTQALYKWYKEW

SEQ ID NO: 122 - protein, 296 aa, Artificial Sequence
  HIBADHbc
MEIAFIGLGNMGGPMAANLLKAGHALTVFDLDAHAVDAAVRAGAAAATSPRDAAARGSLIITMLPAAQHVRAVYLGDDGVLAGARAGATLIDCSTIDPGTVRAVADAAAQRDFPLADAPVSGGTGGAQAGTLTFMVGADGALFERIRPVLLDMGRNVVHCGGTGTGQIAKICNNLLLGISMMGVSEAMALGAALGIDPTVLAGIINTSTGRCWSSDAYNPYPGVSDTAPAARGYAGGFAANLMLKDLGLATEAARSAHQPVWMGALAQQLYQSMSQQGLGTLDFSACVKLYEAQPA

SEQ ID NO: 123 - protein, 295 aa, Artificial Sequence
  HIBADHma
MAKITFIGLGNMGGPMAGNLVKAGHEVTVFDLSKDAVAALVSEGAKTAGTAHEAASGAECVITMLPAGQHVEAVYLGDDGLLAKLPAGTLVIDSSTIAPETARGVAEVARAKDIPFLDAPVSGGVGGAKAGTLTFICGGSEEAFNKAKPILDTMGKNIFHAGDHGSGQVAKICNNMLLAILMSGTSEALALGVKNGLDPAVLSEIMKQSSGGNWALNVYNPWPGVMEGVPASRNYEGGFLVNLMTKDLGLAFDNAVKNQASIPMGSLARNLFQLHAGQGNGSLDFSSIQRLYKPE

SEQ ID NO: 124 - protein, 298 aa, Artificial Sequence
  HIBADHpa
MTDIAFLGLGNMGGPMAANLLKAGHRVNVFDLQPKAVLGLVEQGAQGADSALQCCEGAEVVISMLPAGQHVESLYLGDDGLLARVAGKPLLIDCSTIAPETARKVAEAAAAKGLTLLDAPVSGGVGGARAGTLSFIVGGPAEGFARARPVLENMGRNIFHAGDHGAGQVAKICNNMLLGILMAGTAEALALGVKNGLDPAVLSEVMKQSSGGNWALNLYNPWPGVMPQAPASNGYAGGFQVRLMNKDLGLALANAQAVQASTPLGALARNLFSLHAQADAEHEGLDFSSIQKLYRGKD

SEQ ID NO: 125 - protein, 295 aa, Artificial Sequence
  HIBADHxc
MSKIAFIGLGNMGGPMVANLIKAGHELRVFDLVHSALDTAHAAGAQVASSASDTLHGAEVVISMLPASKHVEGLYLGDAGILAHIPAGALVIDCSTIAPAMARTVATAAHARGLDMLDAPVSGGTAGAAAGTLTFIVGGAAQALERARPVLQAMGKNLFHVGDNGAGQVAKLCNNMALGVIMAATGEAIALGVAQGLDPAVLSQMMAVSTGRSWATEVCNPWPGVLENAPASRGYSGGFGNDLMLKDLGLVAEAAVQAGASIPLGELARNLYAMNSRAGNGALDFSSVVKLVAKV

SEQ ID NO: 126 - protein, 253 aa, Artificial Sequence
  HPDHam
MTQQTVFVTGASAGFGAAIARRFVAEGARVIAVARSEDKLEKLAGELGDAVLPVKLDVSDPEAVKEVVTNLPADWQQVDVLVNNAGLAKGLEPAHKADLQDWDEMIATNVRGLTHVTRALLPGMVERGRGHVINIGSIAGTYPYPGGNVYGATKAFVHQFSLNLRSDLHGTGVRVTNVEPGMVGGTDFSKVRFDGDQAKADKVYEGTTPLTAEDVAESVFWAANQPAHVNINVIELMPVVQSFSPLQIFRDNS

SEQ ID NO: 127 - protein, 550 aa, Artificial Sequence
  HPDHbs
MTAGKGKGAKVDPAGGKAATGRLAGKVALVTGAAGNLGGAIIRRFIAEGATLVMTGRTKERLAAAKQALLDETGVEEARVFTVILDGADPDSVRAGIDQVRAALGRIDVLVNNAGSAGPRQTLENVPLTRAEMEANGDSETVADAMRNLLGVSWNLTRAAAPIMPVGASVVNISTIFSHTRYYGRTAYVVPKAALNALSQELAKELGASGIRVNTVFPGPIESERIRTVFAAMDALQGEPENSTANHFMGRMTLERAIGDAPKRKTLPVPGDIADACLFLASDESAALNGNEIDVTHGMQVRKDSRSTYMTRPSMRSLDGAGLTVLIAAGEAWEDALDMAKIQAACGARVLLGMTRQVDVAQAEARVKAQGAEEGLTIMRFNRAEPDGMEAAIRAYSDAHGAIHSAIVLPVKPAGHFGDSLVEASDAEVDALIDIELTGAIAVARTLRRYWKTCSDLMQDPRFVFMSGPSDGKGNKAGRILAAAIAQLITIWRDESRVDFAQGRQKRAAWGNQIVRYTNEEDENTRFAAGHATRIVFKEQKITETSLYLP

SEQ ID NO: 128 - protein, 550 aa, Artificial Sequence
  HPDHca
MSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWGAGENTGGIHAAVILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANI

SEQ ID NO: 129 - protein, 550 aa, Artificial Sequence
  HPDHcag
MSVTGRLAGKIALITGGAGNIGSEMTRRFLAEGATVIISGRNSAKLAALAERLRSEAGVPAKRIDLEVMDGSDPAAVRAGVAAIIGRHGHIDILVNNAGSTGAQRRLAEIPLNETDRDLDDEEALSTSVANLLGMAWHLMRILSPHMPPGSAIINISTIFSRAEYYGRIPYVVPKAALNTLTQIAARELGIRGIRVNTIFPGPIESERIQTVFQRMDQLKGRPEGDTASQFLATMRLYRANDQGQLERRFPTICDVADAAVFLASDEAAALTGETIEVTHGMELPTSSETSLLARTDLRTIDANGRTTLICAGDQIEEVMALTGMLRTCGSEVIIGFRSEAALAQFEQAIGESRRLAGESFIPPIALPIDLRNPSTIDALFDWAGENTGGIHAAVILPASGREPATQVIDIDDAHVQAFLNDEIVGSIIIASRLARYWQAQRIAPGARAREPRVIFLSNGASTAGNPYGRIQSAAIEQLIRVWRHEAALDYERATAAGERVLPAVWASQIVRFANRSLEGLEFACAWTAQLLHSQRRINEITLTIPADIS

SEQ ID NO: 130 - protein, 550 aa, Artificial Sequence
  HPDHct
MRRTKPECLRRNESTMRLNGKVALITGAAGGIGSVVTRMYLREGARVAISSRSLERAEQFRAALMAEGFSGDDILPVAFASTDLAGMQTAIEAIAARWGGLDVLINNAGSAGAKQPLFRIPFTSEDLAQLAAEGFTETETMRESAANLLGMPWHLTRLALPYLRVGASIINVSTIFSRTNYYGRIPYVVPKSALNALSLGLAKQLGTTDRAVRVNTVFPGPIDSDRIRTVFGAMDRLKGVPEGTTAQEFFDIMILARARGGEAPTKCYPTQADVAHVILFLGSDESAAISGHNFEITHGMQVKAQSRTKLTAWPDQRLIDLSRRVVLIVGGEQVHDAVTIAASQQSYGASVILTFRQPEAVNTAKAQLESRGLNHSIAVTWLDPLRRESVTSVFDLIRERYHRLDTVIVFPAHAAGHYGPELIPDEPERIRQFTDEAILGTTAFAAQLSRFLLAFDAENELQEPVNVLFVTNEHDGATNAFEDIYRAAVEQLLRVWRHEDELQVAAGTRRFAVRTNQIVRYANAEPDNLKFTADWLATLANRVRIFDELN

SEQ ID NO: 131 - protein, 248 aa, Artificial Sequence
  HPDHec
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 132 - protein, 196 aa, Artificial Sequence
  HPDHed
MSEAITPGALETLFTGARTHNGWQNMPVSDETLREIYNLMKWGPTSANCSPARIVFVRSAEGKEKLRPALSSGNLEKTLTAPVTAIVAWDGEFYERLPELFPHGDAKSWFTASPALAEETAFRNSSLQAAYLIFACRALGLDTGPMSGFDRQKVDEAFFTGTTLKSNLLINIGYGDPGKLYGRLPRLDFDDACGLA

SEQ ID NO: 133 - protein, 550 aa, Artificial Sequence
  HPDHgb
MNDMSDIPQDLLTQSIAGRRLDNKCIILTGAAGSIGSFITRQLLREGARVMLTGRDQSKLDDFIGDLVSEGFEETFMVSATGDCADPEVCREIVAKTVAAFGPIDVLVNNAGAAGPKFTLRDIPFTEAEQRAADSDQTMFDSAMNLLGAPWNMARAAAPHMSAGASIINVSTIFSRTHYYGRIPYVVPKSGLNALGKGLALELGEKQGIRVNTLFPGPIESERIESVFARMDELQGVEPGSTGKEFRDLMITTRTSDGGLEYKYPTPTDVASGIVWLASDESSALSGHHIEVTNGMQVPAQSRSQLVSWPDKRLEDLSGQVVLILGGDDYQEAVTFAERQIQSGARVMLAFRNLNTVGHARSLVQSRNLGDVQLSHLDPLRRESVDRSMQLIADHFGRLDGVILLPQKPNGEYGYSLTTANDEDVANFVRDEVVAPVAFASAFARNMDQLFAEGEPPAIVYVTNPSDRHGNLMNEIIRASVEALIRGWRHEDETLANTGELPWAVQPNQMVRYDTEDREALTFAADWAATLTNRVRKMDSINLWLPRSIK

SEQ ID NO: 134 - protein, 252 aa, Artificial Sequence
  HPDHhw
MIVLVTGASSGFGRAIAKKFGENGHKVIALARRKERLQSLQKEIPYCEILPCDICDKKAVKQALEALPQDFKSIDILVNNAGLALGIEPAQMCDFKDWERMISVNVTALSYLTHLVLPQMVERKSGHIITLGSIAGKYPYPGGNVYGATKAFVKQFALGLRADLAGTNVRVSDIQPGLAESEFSLVRFKGDKKRANALYEGSNALQPQDIAEAVYWVATLPKHININTLEMMPTSQSFSTLAVHKEYSFLTK

SEQ ID NO: 135 - protein, 267 aa, Artificial Sequence
  HPDHka
MSQGRRAADRLAGKVVLITGASAGIGEATAWEYLFASNGQAKLILTARRLEKLAAIKEEMKKEYPNVKIHVAKLDVSNTEEIKSLLQCLPTEFKSIDILVNNAGKALGSEKVGDIAIEDIKGMMDTNVIGLINVTQAVLPILKEKNSGDIVNIGSVAGRDAYPTGSIYCASKFAVRAFTESLRKELLDTGIRVILIAPGLVETEFSLVRYKGDEKRANSVYEGITALEAEDVAELIVFSTSRKPNTVIADTLIFPTCQGSAFHVHRS

SEQ ID NO: 136 - protein, 314 aa, Artificial Sequence
  HPDHms
MTEKVSVVGAGVIGVGWATLFASKGYSVSLYTEKKETLDKGIEKLRNYVQVMKNNSQITEDVNTVISRVSPTTNLDEAVRGANFVIEAVIEDYDAKKKIFGYLDSVLDKEVILASSTSGLLITEVQKAMSKHPERAVIAHPWNPPHLLPLVEIVPGEKTSMEVVERTKSLMEKLDRIVVVLKKEIPGFIGNRLAFALFREAVYLVDEGVATVEDIDKVMTAAIGLRWAFMGPFLTYHLGGGEGGLEYFFNRGFGYGANEWMHTLAKYDKFPYTGVTKAIQQMKEYSFIKGKTFQEISKWRDEKLLKVYKLVWEK

SEQ ID NO: 137 - protein, 550 aa, Artificial Sequence
  HPDHot
MFMTRLNDKIALITGGAGTIGEVITRRYLEEGATVVMAGRNRDKLDRYRERLITEFHALPERVMVVRMDGSSNAEVRMGIAAVVAHFGRIDILVNNAGSAGARQRLPAIPLLRSELQADETETLADSIGNLIGITWNLIRAAAPFMPAGSSVINISTIFARTDYYGRIPYVVPKAALHALTLAAATELGERGIRVNQINPGPIDSDRIRTVFRRMDELKGVPEQSTADGFFQMMRLRRPNAEGDLVKGFPKTLDVANVAVFLGSAESAALSGETLDVTHGMAVPTESRTTLTSRPGLRAVDGSGHTTLICVGDQIEEAAALTGVLRACGAEVVIGFRSRAAIARFDHLIERGRHLPSQEHVAPVLLYLNPTEPESIDQALRWMATNLDLPTSVIILPAQRQPLPPSVVRASDEEVAYFLRDELSGMIVLASRLARFWQQATLAPGNAPIQPRVLFMTNPDDGQGNLYAEILRAGVEQLCRVWRHESQLDYTRLAQMDAHPPHIRPVWANQLVRFANNEQENLEYCCAWVAKILLSERTIEELNLYLPRQI

SEQ ID NO: 138 - protein, 271 aa, Artificial Sequence
  HPDHps
MSYGSKAAERLANKVILITGASAAAGIGAATAREFAEAAHGNIKLILTARRKDKLDALAKELTDKYDNIKVHTVALDVTKLESIGQFVKDLPQEFADIDVLVNNAGLALGRDPIGEILPEDIQGMFQTNVLGLITLTQAVLPIFKAKNSGDIVNLGSIAGRDPYPGGGIYCPTKAAVKSFSHVLRKELINTRIRVLEVDPGNVETEFSITRFKNDVDKAKAVYANTEPLVAEDIAEVIVFGITRKQNTVIAETLIFSTNQASASHLYKGQV

SEQ ID NO: 139 - protein, 249 aa, Artificial Sequence
  HPDHra
MIIFVTGATAGFGAEIARKFVKEGHKVIATGRRKERLDDLKAELGDALYAVELDVTNRASIEEAIASLPADWQNIDVLVNNAGLALGLEKADKASLEDWDKMIDTNTKGLVYMTRAVLPGMVERNTGHVINIGSTAGNWPYAGGNVYGATKAFVRQFSLNLRTDLHGTHVRVTNIEPGLCGGTEFSNVRFKGDDEKVSKTYDNTNPLTAADVAESVFWASTLPAHVNINSIEMMPVSQSLAGLQVHREG

SEQ ID NO: 140 - protein, 550 aa, Artificial Sequence
  HPDHrc
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRI

SEQ ID NO: 141 - protein, 322 aa, Artificial Sequence
  HPDHsi
MFIHMKSINKVAVVGAGIIGVGWTTLLLTKGYKVNLYTEKKETLEKGLAKVSAYLVNLKNLRMIDGEPIDYQRNLTGTTKIDEAIQNVEFVIEAIIEDYSAKKNLFNYLDSQLPRDIIIASSTSGLLMTEIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 142 - protein, 550 aa, Artificial Sequence
  HPDHsl
MNAMGKTETQGRLAGKVALITGAAGNLGGSIVRRYLAEGATVVMSGRDAARTQAALDAAVADVGGTASIVTMDGANIESVRAGIADVVARHGRIDVLVNNAGSAGPKQVLGDLPLLPEELEGTPDSETVGDAARNIMVVAWNLVRAAASAMGEGGSIINVSTIFSRTDYFGRAAYTVPKAALNILSKGIARELGTRGIRVNQLYPGPIASERIRTVFAAMDKLKGDDAGSTANHFFNLMALERSVGEDAKAKTFPTPADIANTCVFLGSDESAAFAAHDFEVTHGMAVPLESKSEFLHRPDLRAIDGDGHGILISAGNQLDDALAMAGLFAAQGSKVLLGFHAQAALDDAAERLPAGVKAVRFPRHDHMAMDAELARFTAHVAAIDGAIILPTRGPGYFHGALNEASDAAVERFVDDELEGAIAVARTLDRYWQQGQDLPGDPRVLFITNPDDGAGNGWADVGRAAIEELLRVWRDEARVAATQGKTPRPVWGNQIVRFGNNEPENRDFAAGHAARLLLGGRQIEPINLYIPASITKATGARRALAGTAE

SEQ ID NO: 143 - protein, 288 aa, Artificial Sequence
  HPDHsm
MAILITGASSGFGAAMATAFVQAGYLVIGTARRTEKLADLHAKLGDRFQPITMDMTSKDDIQAALAHIQTLPEYFREIDCLINNAGLALGLDRADQADFTDWETMIQTNIIGLTYLTRQILPKMVENKRGYIINMGSIAGNYPYAGSNVYGATKAYVRQFSLNLRADLHGTGVRVTNIEPGLVEGSEFSNVRFKGDDKRAAQLYEYANALTSEDIAQTALWLYQRPAHMNVNTIELMPTTQSWAGMQVYKDTPPPPPPVVEPKPADFAPQPAPQEESGFFSKITSLFK

SEQ ID NO: 144 - protein, 318 aa, Artificial Sequence
  HPDHst
MRQIKTVSVIGAGVIGAGWSTLLALKGYENWFYTEKKETLDKGLAKIKGYLNVLYEYKLIDKEPDYYMQRIHPTTKLDEAISNTDFVLEAIVEEYGAKKALFKQLDEKLDKDVILASSTSGLLMTEIQKAMTKYPERGIIAHPWNPPHLLPLVEIVPGEKTSQDTIYATKDFMENKLERVVVVLKKEISGFIGNRLAFALFREAVYLVDEGIATVEDIDKVMTAAIGLRWAFMGPFLTYHLGGGEGGLEYFFSRGFGYGANEWMHTLAKYDKFPYTGVVKSVQQMKEYEFVKSKTFQELSRWRDEKLISLIKLLRGKI

SEQ ID NO: 145 - protein, 891 aa, Escherichia coli; identical to SEQ ID NO: 94

SEQ ID NO: 146 - protein, 885 aa, Piromyces sp.; identical to SEQ ID NO: 95

SEQ ID NO: 147 - protein, 869 aa, Staphylococcus aureus
MLTIPEKENRGSKEQEVAIMIDALADKGKKALEALSKKSQEEIDHIVHQMSLAAVDQHMVLAKLAHEETGRGIYEDKAIKNLYASEYIWNSIKDNKTVGIIGEDKEKGLTYVAEPIGVICGVTPTTNPTSTTIFKAMIAIKTGNPIIFAFHPSAQESSKRAAEVVLEAAMKAGAPKDIIQWIEVPSIEATKQLMNHKGIALVLATGGSGMVKSAYSTGKPALGVGPGNVPSYIEKTAHIKRAVNDIIGSKTFDNGMICASEQVVVIDKEIYKDVTNEFKAHQAYFVKKDELQRLENAIMNEQKTGIKPDIVGKSAVEIAELAGIPVPENTKLIIAEISGVGSDYPLSREKLSPVLALVKAQSTKQAFQICEDTLHFGGLGHTAVIHTEDETLQKDFGLRMKACRVLVNTPSAVGGIGDMYNELIPSLTLGCGSYGRNSISHNVSATDLLNIKTIAKRRNNTQIFKVPAQIYFEENAIMSLTTMDKIEKVMIVCDPGMVEFGYTKTVENVLRQRTEQPQIKIFSEVEPNPSTNTVYKGLEMMVDFQPDTIIALGGGSAMDAAKAMWMFFEHPETSFFGAKQKFLDIGKRTYKIGMPENATFICIPTTSGTGSEVTPFAVITDSETNVKYPLADFALTPDVAIIDPQFVMSVPKSVTADTGMDVLTHAMESYVSVMASDYTRGLSLQAIKLTFEYLKSSVEKGDKVSREKMHNASTLAGMAFANAFLGIAHSIAHKIGGEYGIPHGRANAILLPHIIRYNAKDPQKHALFPKYEFFRADTDYADIAKFLGLKGNTTEALVESLAKAVYELGQSVGIEMNLKSQGVSEEELNESIDRMAELAFEDQCTTANPKEALISEIKDIIQTSYDYKQ

SEQ ID NO: 148 - protein, 871 aa, Sporolactobacillus laevolacticus; identical to SEQ ID NO: 88

SEQ ID NO: 149 - protein, 912 aa, Togninia minima; identical to SEQ ID NO: 92

SEQ ID NO: 150 - protein, 484 aa, Endozoicomonas elysicola
MELLDKDLASIQEVRNLIRRAKEAQRVLADYSQAQVDALVEAMARTGEANASRLAEMAVEETGFGKVQDKITKNMIASKHLAESVRSMRTIGIIAEDPAKKMQEVAVPFGVVAGLVPSTNPTSTAIYKSIISIKAGNAVIISPHPSALKCIGETVRLLRETLQSLGAPADLISVMTQPTLEGTSELMKNEGTGIILATGGSAMVKAAYSSGNPALGVGPGNVPAFIERTADIKKAVSYILMSKTFDNGTVCASEQHVVTEHVIADQVKAEMIAQGCYFLNETETVRVEKVIVGPRGTLNARIVGKPAVEIARMAGLEIPAATRVLVAEQGRECVGKQHPFSWEKLSPLLGFYRTNDAHEACELCLELLNYEGAGHSLAIHTQNNDLVREFALKKPVSRLVVNTPSTHGAVGATTGLPPAFTLGCGSVGGSATSDNVTPLHLFNKRYVAYGICEPETPVAQVPAAVTELDIEAITRMVIEKLKAL

SEQ ID NO: 151 - protein, 460 aa, Rhodococcus wratislaviensis; identical to SEQ ID NO: 87

SEQ ID NO: 152 - protein, 467 aa, Escherichia coli; identical to SEQ ID NO: 97

SEQ ID NO: 153 - protein, 459 aa, Dickeya zeae; identical to SEQ ID NO: 96

SEQ ID NO: 154 - protein, 469 aa, Listeria innocua; identical to SEQ ID NO: 98

SEQ ID NO: 155 - protein, 478 aa, Morganella morganii; identical to SEQ ID NO: 83

SEQ ID NO: 156 - protein, 474 aa, Thauera linaloolentis; identical to SEQ ID NO: 91

SEQ ID NO: 157 - protein, 480 aa, Atribacteria bacterium; identical to SEQ ID NO: 74

SEQ ID NO: 158 - protein, 465 aa, Marinobacter hydrocarbonoclasticus; identical to SEQ ID NO: 81

SEQ ID NO: 159 - protein, 437 aa, Clostridium cf. saccharolyticum; identical to SEQ ID NO: 78

SEQ ID NO: 160 - protein, 477 aa, Planctomyces brasiliensis; identical to SEQ ID NO: 85

SEQ ID NO: 161 - protein, 462 aa, Shuttleworthia satelles; identical to SEQ ID NO: 89

SEQ ID NO: 162 - protein, 467 aa, Tolumonas auensis; identical to SEQ ID NO: 90

SEQ ID NO: 163 - protein, 477 aa, Pediococcus acidilactici; identical to SEQ ID NO: 84

SEQ ID NO: 164 - protein, 464 aa, Blautia sp.; identical to SEQ ID NO: 76

SEQ ID NO: 165 - protein, 484 aa, Bilophila wadsworthia; identical to SEQ ID NO: 77

SEQ ID NO: 166 - protein, 473 aa, Mahella australiensis; identical to SEQ ID NO: 82

SEQ ID NO: 167 - protein, 477 aa, Acetonema longum; identical to SEQ ID NO: 75

SEQ ID NO: 168 - protein, 467 aa, Veillonella sp.
MNLEMIESIVKQVVKDLQQEGVGMETTRYEYGVFDTMEAAIDASEVAQRELLAFSLQDRNAFVDAIRETVLQKDHLEMISLMAVEETGIGRYSDKLIKNRVAAVKTPGKEVLETRAMTGHDGLTIEEFCPFGVIGAITPTTNPTETIINNSISMIVGGNTVVFSPHPRAKKVSTILVQMINKALEAAGAPNNLVTMVREPSIESTQCMMSHPKVRLLVATGGPGIVNQVLSSGKKAIGAGAGNPPVVVDETAHIEQAAKDIVSGASFDNNVPCIAEKEVFVVESVADQLVYHMKKNGAYEITDMSILDTLVEKVTKKDGKPNPDFVGKSAKDLLALVGIVVDDSIRLIIARTSEHHHLVTEEMMMPILPIVAVPNVDIAIECAYRAELGNRHTAMMHSQNLEKLSKMARLLETTIFVKNAPSYAGIGVGGEGHTTFTIAGPTGEGITCARSFCRIRRCVLSEAFSLR

SEQ ID NO: 169 - protein, 532 aa, Vibrio sp.; identical to SEQ ID NO: 93

SEQ ID NO: 170 - protein, 491 aa, Opitutaceae bacterium
MSAFTLDETALRTVVEEVLRGLGRNGAASSNGSAPAAAPAVVAPRVPQGRFGVFNDVAAAASAAQGAFLQLQQAGLAGRSKVIEIVKDLATRNAVEWGRIEFEETKIGRLAHKVEKLQIVKLVPGLEWLRPYALSGDHGITLEECVPFGVIGAITPVTHSVPTICGNIVAMVAAGNAIVVNPHPGGARCAAIAIRAINEAIHAATGIEHLVCVIAEPSLETFDALCKNGTVRLLCVTGGPGVVAAAMKSGKRAICAGPGNPPVVVDGTGSLAKAAADTLTGAAYDNNLLCVGEKQVFVLEHIADRFMTELAAAGAAKLNSSQLAALTAAAFTTAKDAGGCSHPVLNRKLVGVDAAVLARHAGATVSADTPLLFAETDANHPFVVEEQMMPMIPVVRVKTFDEAVTQATKSEHGYKHSAIIHSLNVEHMTQMARALDTTVFVKNGPSTAGLGLGGEGYLNYSIATTTGEGIATPRTFTRTRRCVMVDNLRIY

SEQ ID NO: 171 - protein, 467 aa, Halanaerobium saccharolyticum; identical to SEQ ID NO: 80

SEQ ID NO: 172 - protein, 485 aa, Haliangium ochraceum; identical to SEQ ID NO: 79

SEQ ID NO: 173 - protein, 452 aa, Porphyromonas endodontalis; identical to SEQ ID NO: 86

SEQ ID NO: 174 - protein, 475 aa, Azospirillum brasilense
MDNIMLDRTPASADQEAIAALVARARTAQRAFADATQERVDDAVAALAWAIYEPGRARALAELAVADTGLGNVADKIVKNQRKTFGTLRDLMRVRTVGVIEEDTAKGIVKIAKPLGVVGAVTPSTNPAATPVNKAMMAVKGRNAIIIAPSPMGSAATGRTVELMRAELARIGAPEDLVQMIPTPITKGLTQALMEAVDLVVVTGSQDNVRRAYSSGTPAIGVGAGNVPVIVDESADLAEAARKIGASKTFDNSTSCSSENALVVLDSVYDATIAALEEAGAHLCTPEERERVQSRLWENGKLNRKLIAKDPAILAEAFELAPKAREARFFLVEETGVGKAHPFSGEKLSLVLAVYRVPDFDAAVDQVRKILDHQGRGHSCGIHTRDEAHAKRLADELDVVRVLVNFAHTFGNGGGFDSGLNFTLSMGCGSWQKNSISENLSWKHFVNITHLVRPIPEDKPSEEALFGPFWSRHGR

SEQ ID NO: 175 - protein, 455 aa, Peptostreptococcaceae bacterium
MLDPNSMVNELIRRARTAQTEFETYSQERVDKAVRAIGKSIYDHGDELAKMGAEESGMGRYEDKIVKNQGKSKMTWWRLKGVKSRGIINIDREKQIYEIAKPIGVLGVVTPATNPTMTPVHNAMIALKGANAVIICPHPKTRKTTSKTVEYMRLALKDISVPEDLIQIVDDPSIEVSQALMAFCDTTISTGGPGMVKSAYSSGKPAIGVGPGNVQCLVGDDADIDAIVPKIMKGRTYDNGVLCTCEQSIICAENLYDRLVKGLVDNGAYFVKEDEVEKLRNGFFPGGVMNKNLVGSSPFEIAKASGFEVQEESKILLVPVSKTGKDEFLAKEKLAPILALYKYSEWKEAVDIALKNLLNEGRGHSVVIHSANKTNIEYAANILPVSRVGVGMVGSSGLGGGFDNGFMPTATLGCGSWGNNSIAGNVWWNHLVNITKLAYVLNDVSIPTDEEIWAE

SEQ ID NO: 176 - protein, 469 aa, Terriglobus roseus
MAPKVITEEQKEQIAEMVARAKVALDAIKDYDQPKVDRLCQALGWAVANETTFTRLSNKSIDESGLGDRETRPGKRTKVVGVLRDVLRQKSMGIIEEIPEKGIVKYAKPVGVIAALVPVTNAALTEIVTGIFTIKAKNVAIFAPHPAAKNTTIETVNIMREVLKREGVPEDVFQVIEKPSIPVANELMASCDLTVATGGPAMVKAAYSSGKPAYGVGAGNATMVFDETTIAEEAARNTRISKAHDNGSGCSSDGNLVVEATVYDRVLQCLQDEGGYLVSPEEKIKLQAIMWDDERHRTAPTIARAASVIAELAGFSIPEGKRFLIVPETGIGKDYPFCSEKLSPVLAIFKYDGWDNALRMVTDIYKVGGRGHSVGIYSFNDEHIDELARMAPVSRITVRQPQSRANSGSFNNGLAMTSSMGCGIWGGNITNENVVLKHYMQTTWVSRPIAEDRPPDEEIFGEFYNSKTY

SEQ ID NO: 177 - protein, 2233 aa, Saccharomyces cerevisiae; identical to SEQ ID NO: 104

SEQ ID NO: 178 - protein, 2266 aa, Yarrowia lipolytica; identical to SEQ ID NO: 105

SEQ ID NO: 179 - protein, 2216 aa, Mucor circinelloides
MVEHRSLPGHFLGGNSLESAPQGPVKDFVQAHEGHTVISKVLIANNGMAAMKEIRSVRKWAYETFGNERAIEFTVMATPEDLKANAEYIRMADNFVEVPGGSNNNNYANVELIVDVAERTAVHAVWAGWGHASENPRLPEMLAKSKHKCLFIGPPASAMRSLGDKISSTIVAQSAQVPTMGWSGDGITETEFDAAGHVIVPDNAYNEACVKTAEQGLKAAEKIGFPVMIKASEGGGGKGIRMVKDGSNFAQLFAQVQGEIPGSPIFIMKLAGNARHLEVQLLADQYGNAISLFGRDCSVQRRHQKIIEEAPVTIAKPDVFEQMEKAAVRLGKLVGYVSAGTVEYLYSHHDDQFYFLELNPRLQVEHPTTEMVSGVNLPAAQLQIAMGIPLHRIRDIRVLYGVQPNSASEIDFGFEHPTSLTSHRRPTPKGHVIACRITAENPDAGFKPSSGIMQELNFRSSTNVWGYFSVVSAGGLHEYADSQFGHIFAYGENRQQARKNMVIALKELSIRADFRSTVEYIIRLLETPDFEENTINTGWLDMLISKKLTAERPDTMLAVFCGAVTKAHMASLDCFQQYKQSLEKGQVPSKGSLKTVFTVDFIYEEVRYNFTVTQSAPGIYTLYLNGTKTQVGIRDLSDGGLLISIDGKSHTTYSRDEVQATRMMVDGKTCLLEKESDPTQLRSPSPGKLVNLLVENGDHLNAGDAYAEIEVMKMYMPLIATEDGHVQFIKQAGATLEAGDIIGILSLDDPSRVKHALPFNGTVPAFGAPHITGDKPVQRFNATKLTLQHILQGYDNQALVQTVVKDFADILNNPDLPYSELNSVLSALSGRIPQRLEASIHKLADESKAANQEFPAAQFEKLVEDFAREHITLQSEATAYKNSVAPLSSIFARYRNGLTEHAYSNYVELMEAYYDVEILFNQQREEEVILSLRDQHKDDLDKVLAVTLSHAKVNIKNNVILMLLDLINPVSTGSALDKYFTPILKRLSEIESRATQKVTLKARELLILCQLPSYEERQAQMYQILKNSVTESVYGGGSEYRTPSYDAFKDLIDTKFNVFDVLPHFFYHADPYIALAAIEVYCRRSYHAYKILDVAYNLEHKPYVVAWKFLLQTAANGIDSNKRIASYSDLTFLLNKTEEEPIRTGAMTACNSLADLQAELPRILTAFEEEPLPPMLQRNAAPKEERMENILNIAVRADEDMDDTAFRTKICEMITANADVFRQAHLRRLSVVVCRDNQWPDYYTFRERENYQEDETIRHIEPAMAYQLELARLSNFDIKPCFIENRQMHVYYAVAKENPSDCRFFIRALVRPGRVKSSMRTADYLISESDRLLTDILDTLEIVSHEYKNSDCNHLFINFIPTFAIEADDVEHALKDFVDRHGKRLWKLRVTGAEIRFNVQSKKPDAPIIPMRFTVDNVSGFILKVEVYQEVKTEKSGWILKSVNKIPGAMHMQPLSTPYPTKEWLQPRRYKAHLMGTTYVYDFPELFRQSVQNQWTQAIKRNPLLKQPSHLVEAKELVLDEDDVLQEIDRAPGTNTVGMVAWIMTIRTPEYPSGRRIIAIANDITFKIGSFGVAEDQVFYKASELARALGIPRIYLSANSGARIGLADELISQFRAAWKDASNPTAGFKYLYLTPAEYDVLAQQGDAKSVLVEEIQDEGETRLRITDVIGHTDGLGVENLKGSGLIAGATSRAYDDIFTITLVTCRSVGIGAYLVRLGQRTIQNEGQPIILTGAPALNKVLGREVYTSNLQLGGTQIMYKNGVSHLTAENDLEGIAKIVQWLSFVPDVRNAPVSMRLGADPIDRDIEYTPPKGPSDPRFFLAGKSENGKWLSGFFDQDSFVETLSGWARTVVVGRARLGGIPMGVVSVETRTVENIVPADPANSDSTEQVFMEAGGVWFPNSAYKTAQAINDFNKGEQLPLMIFANWRGFSGGQRDMYNEVLKYGAQIVDALSNYKQPVFVYIIPNGELRGGAWVVVDPTINKDMMEMYADNNARGGVLEPEGIVEIKYRKPALLATMERLDATYASLKKQLAEEGKTDEEKAALKVQVEAREQELLPVYQQISIQFADLHDRAGRMKAKGVIRKALDWRRARHYFYWRVRRRLCEEYTFRKIVTATSAAPMPREQMLDLVKQWFTNDNETVNFEDADELVSEWFEKRASVIDQRISKLKSDATKEQIVSLGNADQEAVIEGFSQLIENLSEDARAEILRKLNSRF

SEQ ID NO: 180 - protein, 2237 aa, Cryptococcus gattii
MSSATPNGSAVNGPSDIYDHSKVAQFIGANSVESAPSGRVTDFVKAHNGHTVITKVLIANNGIAAVKEIRSIRKWSYETFGSERQIEFTVMATPEDLRINAEYIRMADRYVEVPGGSNNNNYANVDFIVDVAERAGVHAVWAGWGHASENPRLPETLAKSKIVFIGPPGSAMRSLGDKISSTIVAQHAKVPCMAWSGTGISDTVLSPQGFVTVPDKAYDDACVHNWEEGLERAEKIGFPVMIKASEGGGGKGIRKVEDGEKFKNAFQAVAGEVPGSPIFIMKLAGSARHLEVQLIADQYGNAISLFGRDCSVQRRHQKIIEEAPVTIAKPDTFEEMEKAAVRLAKLVGYVSAGTVEYLYSHSDDSFYFLELNPRLQVEHPTTEMVSGCNIPAIQLQVAMGIPLHRIRDIRTLYGMDPHGITEIDFYGSKPESVNTQRKPTPKGHVIACRITGENPDAGFKPSSGNLTELNFRSNSNVWGYFSVSSAGGLHEYADSQFGHIFAYGMERSEARKSMVVALKELSIRGEFRTTVEYLIKLLEKPEFENNTLTTQWLDGLIAEGMTSERPDPVVAVVCGAVVKAYIAYEASLAKYKSVLDKGQVPSKDSLQTFFKSEFIYENVRYSFAMAKSSAYSFTLYLNGGRIFVGCRGLSDGGLLISLGGASHTVYFREEVGAMVLSVDSKTTLIEDEQDPSQLRSPSPGKLVRYLIDSGDHVNAGDAYAEIEVMKMIMPVTASESGIAQFMKQPGQTLAAGELLGILTLDDPTKVKFAKPFEGILPTFELKDGRYGTKPHQRLREHLEVLYDNLSGYDNSASVLSSLRIVEAALRDADLPYSNAQGVMSTLSGRIPQKLEEDIRSTLDSCRAKQLEFPSLKLQHIIDVFVEENVMPKERPQVIAAISPLKTLIDAFAHGLKVHEWQTWADLLNFFADVEEPFADTARTQENVILKLRDDCKDLDQVVNLVLSHSKIALKTKLVLALLDIIKSESPRASMTPESRVNDALGRLAALDSRPTAKVALKAKEVMIVGSLPSYEERLGQLERLLSAAVTTSYYGQQGSGHRLPSGDVLKEVTDSRYTVFDVLTTFFDHDDPWVALAALEVYVRRAYRVYNVLHLDYEAGEKGGEPHIITWRFKLGGHQSEPITPRVDSTKDFTRIASMSDLSYVVNTKTEPVRFGLMTSYNDLASLEQGFAKLLSMYPAFSHVEHIEKFGGDARHPHVMNVALRLFNGEQMSDIELNVRFHALANRYATGISGKGIRRVSFVICRKDQYPAYVTLRESAEGSWKEEEAIRDIEPALAYQLELGRLSNFKITPQPSSNRQIHVYHAVGRENTSDVRFFVRALLRPGRFQGNMQVKEYLISETDRLVGDILDTLEVVSSQHRQADCNHIMVNCVYNLNVTFDDIQEALAGFIERHGKRLWRLRVTQAEIRVVIEDEEGNVLPIRSFIENVSGFVVKYEAYQEIDNDKGKSILKSIGENGQFHLQPVNFPYSTKESLQPRRYQAHVIGTTYVYDFPDLFRQATDKAWHNLQAFLPNIKIPSDLLTATELVSDERGELQEVTRAPGLNTCGMVAWVYTLKTPEYPQGRRVVVISNDITYQIGSFGPAEDEFFYKATQYARKHGLPRIYLSANSGARIGLAEEVMALFDVAWHEAGKPEKGFDYLYLTPANLEKLNDMGSGSVITDEIEVNGERRHKIVSIIGLKDGLGVECLRGSGLIAGETSRAYDDIFTISMVTARSVGIGAYLVRLGQRVVQVEGQPIILTGAQAINKVLGKEVYTSNIQLGGPQIMYKNGISHLTAGSDLDGALQIINYLMFIPEQRGRAIPILPTGDHWDRAVEWKPTKAAYDPRNFLSGCNEDVDGVQSWKSGILDNGSFFETMGGWAQTIVTGRGRISGIPVAVIAAETRSIERVDPADPANENSQENRVSLAGTVWFPDSSRKTATAIEDANREGLPLVIFANFRGFSGGMSDMAQAILKEGAKIVDGLSSYKHPVIVYLVPNGELRGGAWVVLDPSINPEHMTMFVDNESRGGVLEPEGIVEVKYRKPKVQATMARLDEEYARLKKEVENPNASPEQKTAATAKLEAREKHLGPAYQSVALEFADLHDRSGRMKAKADCTPCDWENSRRAIYWSLRRKLSEIRILKKLENANPRLTYPQRKELLQQFVPAELSSDSEVAAYIEKSGETIESFIQGVRDEWCSDTLVSWAGTNQDGVMSGFKRILEGLSVEQKAQVLAELGVQSQA

SEQ ID NO: 181 - protein, 2236 aa, Agaricus bisporus
MSVYDHSRVQHFIGGNSLDKAPPSSVKNFVQSHGGHTVITKVLIANNGIAAVKEIRSVRQWSYETFGGDREIEFTVMATPEDLKVNAEYIRMADRYIEVPGGSNNNNYANVDLIVDVAERAGVHAVWAGWGHASENPKLPESLAASKHKIVFIGPPGTAMRSLGDKISSTIVAQSADVPTMSWSGTGITETVLSEAGYVTVPDSVYAQACVETVEDGLKRAEQIGWPVMIKASEGGGGKGIRKVERPDQFKNAFHAVEGEIPGSPIFIMKLAGQARHLEVQLLADQYGDAISLFGRDCSVQRRHQKIIEEAPVTIANEDTFERMEQAAVRLSKLVGYVSAGTVEYLYSHEDDYFYFLELNPRLQVEHPTTEMVTGVNLPAAQLQIAMGIPLHRIRHIRTFYGVAPTGSSEIDFDMTKPESNQLQRKPKPKGHVVAVRITAENPDAGFKPSSGSLQELNFRSSTNVWGYFSVGTAGGLHEFADSQFGHIFAYGEDRSESRKNMIIALGELSIRGDFRTTVEYLIKLLQLEAFKDNKFTTGWLDSLISSKLTADRPDFTLAVVCGAVTKAHIASEACWYEYKRILDKGQVPARDVLKTVFGVDFIYENVRYSFTCARSSVTTWTLYLNGGRTMVGARPLADGGLLVLLDGRSHTIYWREEVGALRLMIDSKTCLIEQENDPTQLRSPSPGKLVRYFVDSGDHINAGEQYAEIEVMKMYMPLVASEDGIVQLIKQPGVSLEPGDILGILTLDDPARVNHAKPFDGLLPPLGTPGLIGNKPHQRLSYALGVLNDILDGYDNQSIMAGTFKDLVAVLHDPALPYDETNSVLSSLSGRISPKLEESIRSAMDAAKAKGDGREFPAGRIKKALEHHIIAEVPAADKSKVRMQLSVLFEIAERHLGGAKGHEISVLANLLGRYEATEKLFGGSIEARVLALREQYKDDLDKAIGFVLSHIKAQSKVKLVLTILDYIKSSGISVSNPESRLYKVLQDLAALEAKSSTAVCLKAREVLILGQMPSHEERRIQMETVLKNSVSNNYYGEAGQSGNRSPSADVLKELSDSRYTVFDVLPSFFSHSDPLVTLAAFEVYVRRAYRAYSLLSIDYEEGDTLDDGEVPNILTWRFNLGQSHSPPSTPRFGPSSSHARQGSVSDLTYMISRHQSQPVRVGAIASFPNLKALVKGFSKVMATLPVFDYEDFKERYGSDVQPPNVLNIALRVFREEDDLPESEWVEKLIKFANDHTETLTHKGVRRATFLICRPTLYPTYYTLREMNGVWGEEKAIRNTEPALAFQLELSRLSNYTLKPVFVETKQIHVYHAVAHENQLDNRFFVRALVRPGRLRGAMSTAEYLISETDRLVTGILDALEIVSSQYRNADCNHIFMNFVYNLAVTYDDVLAAISGFIERHGKRLWRLHVTGSEIRLSLEDKEGNVTPIRCIIENVSGFIVNYHGYQEITTDRGTTMLKSIGEKGSLHLQPVHQSYPTRESLQPKRYQAHLNGTTYVYDFPELFSKALQNFWQKVRTANPNVVSPKTYLESKELVLDELDQLVEVDRAPGNNTFGMVAWVFTLFTPEYPHGRRVVVVANDITFKIGSFGPEEDQFFYHVTQYAREQGLPRIYLSANSGARIGVAEELLPLFSVAWIDDKHPEKGINYLYLTPDNLIEIEQKGKDIVHVEEIQDQGERRFKITDIIGLQDGLGVESLKGSGLIAGETSRAYDDIFTITLVTARSVGIGAYLVRLGERAVQVEGQPIILTGAGALNKVLGREVYTSNLQLGGTQIMFKNGVSHLTAGSDLQGATQILEWLSYVPEFKGAPLPIWETVDSWDRDIEYILPKTPYDPRWFIEGKHDETSDQWKSGFFDKGSFQETLNGWAQTVVVGRARLGGIPMGVIAVETRTIERIVPADPANPASFEQRIMEAGQVWYPNSAYKTAQAIFDFNREGLPLIIFANWRGFSGGQQDMYDEILKQGSKIVDGLSSYKQPVFIYIVPNGELRGGAWVVLDPAINPEQMEMYADADARAGVLEPEGIVEIKLRRDKILRMMERLDSEYSMLVRQSKDSAKSDEERAAATAAIAQREQLLQPSYKQIALLYVDLHDRIGRMEAKGCAKPAEWKNARRFFYWAVRARVARSAALESLAEANPDTTYDDRLRLLTSLTGTVPPANYEEEAAALEKLDLTATIAQLKADQLAHRLVDLTKEDRKVVLDGFLRFTDELSEDERATVINALQGAPRSPVPTYANANVS

SEQ ID NO: 182 - protein, 2273 aa, Batrachochytrium dendrobatidis
MPASGNGNLNESANGSTPILGGSVFSPSRNNSIGATPNTALKDFVLQAKGHTVITKVLIANNGMAAVKAIRSIRKWSYETFGNERLIEFTAMCTPEDLNMNAEYVRMADHYIEVPGGTANNNYSNVQLIVDVAERTHVHAVWVGWGFASENPVLVEKLALLNPAVVFIGPPASAMRSLGDKIASTIVAQSANVPCVHWSGDGITIDTEQSTGKTACATVPEDKYHQATTHDVNEGLMHAKRIGFPVMIKASEGGGGKGIRLVDDEVAFASSFVQVQREVPGSPIFIMCVVSNARHLEVQLLADAYGNAIALFGRDCSVQRRHQKIIEEAPISVAPPEILSHMERSAVRLAKLVGYVSAGTVEYLYEPHTQKYYFLELNPRLQVEHPTTEMVSGVNIPAAQLQIAMGIPLSNIKDIRILYGLTPTGLSDIDFDFESPASLQIQRKPSPRGHVIATRITAENPDAGFKPNSGKVLELNFRSNSNVWGYFSVNSSGGVHEYADSQFGHIFSYGESRDDARKNLIMALKEISIRGDFRTTVEYLIKLLETEVYVSNTFTTQWLDARIAKHVEIQRPDTILTAICGAVAKAYGQFTKNTLEYRTALEKGQTPPTLLLKTSFSVQFILDNVQYNMHVALTGPENYVVTVNKSSVEVHAKPLADGGLLLLLDDHSHLVYANEESHVTHLLVDAKTSLLEKENDPTKLRSPSPGKLVRYLVADGHQLKSGDAYAEIEVMKMYMPLLASESGIVKFIKPAGSSLSSGDIIGTLVLDDPARVQRATVFEDPLPVIGAPTVVGDKVHQQYKYVRSSIEAILDGYEPSTDAGLLVKRLDTLLADKDLPQLEFTEVLGALVGRIPAGLGDALLKIVNEYHASGDPDVFPADSLRHLIDVAVNDMPIDERILFTGIIVSVQNVIDTYAGGLTLHANAVFMKLLDRYISVESIFNSARYETAILDLRDKHKSDLMVVQQLALASSKADTRCEMVLELLNTVRSDCEEIKQVFMPYLESLADFKGRSTAKVSLKARELLIYFQLPSAEERRAIMLTQLRGGIKSRRTDGIAGDANLQFDYSALTKLIMAQQSILDVLPSFFYDADEGIRAIALYTYVLHTYQAYSITSIKQHLGGSPTVFTWEFVLRQAQGTSSTALTRISSLGSFRDLRSLNYGSDFATPRRGAICAFESVDQLCTHLPRILAEYGVSKSTTEMDNRSISDVWNIAIRDDSGSYTDKEIHGILHTTIAKCHAELRQSFVRRITIMVVRFGQFPRYFTFKATRNYFEDALLRHIEPAMAYQLEFESLQNFDVKPCFVDNRRLHIYYGVGKKNTSDVRFFIRAIMYPGHILSNMRTHDFLVSEGNRILTDVLDALELLSATHPNTDCNHLFLNIIPTFQLDLDEMESSLRSFVERHGKRLFKLRVTTAEVRFLRKIPGSDIIQPVRFVVSSHSGYVMQVQAYQEVLDVTGFKKLVSLLSPPGPMHNQPVSSPYAPKEAIQPKRYKAHLMGTTYVYDFPELFRRTLEKTWQKYAGAQGIKPPTTVMSATELVLDAQNKLEPTYRPPGSNTCGMVVWELELRTPEYPEGRHIIIISNDITFNIGSFGPTEDLVFFKASEYARKRGIPRIYISANSGARIGLAEEVASRFQIAWIDSSNPVKGFDYLYLSESDYELLKRDAASKRQPPPVEVEKLIVDDTVRYKLTTVIGQTHGIGVENLQGSGMIAGETSRAYEEIFTLTLVTCRSVGIGAYLVRLGQRVIQVEYTPIILTGVGALNKVLGREVYTSNLQLGGTQIMHRNGISHLVAENEMEGVNEILRWLEYVPKHRDAPLPVVAPSDPVDRPIDIPIPSGAYDPRTLLCGTEDPDKGWMSGFFDKESFTETLSGWAKGVVVGRARLGGIPVGVIAVETRTTEHIVWADPAVESSQEQTNMEAGQVWYPNSAFKTAQAIKDFNNGEQLPLMIFANWRGFSGGQGDMYKEILKFGAYIVDSLRTYKQPVFIYLIGELRGGAWVVVDPTINSDMMEMYVSEDARGGVLEPEGIVEIKFRKPQLIAAIQRLDEPFRDLKKQLDKATTSEERTAIQRNLDAREKVLLPIYQQAAVQFADLHDKPYRMLAKQVVKHIVPWRESRGFYYWRLMRRISEISVVKSIRQAMGPNDVSYSDALFHLNTWFGEFSGRLNNMMSGQIADNAFRSGGVSGTAQPHAYSGTMALASGAAGSTQEGRDVDVVRWIHQSRNTIDENIARLTMERQATEAKRLAVDSPTAILDAFLGMASGLDAEAKRKVIEALSNN

SEQ ID NO: 183 - protein, 2233 aa, Rhodotorula toruloides
MPFSGEAKAVNGSHSVDEAPKNPKYDHGRVVKYLGGNSLESAPPSKVADWVRERGGHTVITKILIANNGIAAVKEIRSVRKWAYETFGSERAIEFTVMATPEDLKVNADYIRMADQYVEVPGGTNNNNYANVDVIVDVAERAGVHAVWAGWGHASENPRLPESLAASKHKIVFIGPPGSAMRSLGDKISSTIVAQHAQVPCMDWSGQGVDQVTQSPEGYVTVADDVYQQACVHDADEGLARASRIGYPVMIKASEGGGGKGIRKVEKEQDFKQAFQAVLTEVPGSPVFIMKLAGAARHLEVQVLADQYGNAISLFGRDCSVQRRHQKIIEEAPVTIAKPDTFEQMEKSAVRLAKLVGYVSAGTVEFLYSAADDKFAFLELNPRLQVEHPTTEMVSGVNLPAAQLQVAMGVPLHRIRDIRTLYGKAPNGSSEIDFDFENPESAKTQRKPSPKGHVVAVRITAENPDAGFKPSMGTLQELNFRSSTNVWGYFSVGSAGGLHEFADSQFGHIFAYGSDRSESRKNMVVALKELSIRGDFRTTVEYLIKLLETDAFEQNTITTAWLDSLISARLTAERPDTTLAIICGAVTKAHLASEANIAEYKRILEKGQSPAKELLATVVPLEFVLEDVKYRATASRSSPSSWSIYVNGSNVSVGIRPLADGGLLILLDGRSYTCYAKEEVGALRLSIDSRTVLIAQENDPTQLRSPSPGKLVRYFIESGEHISKGEAYAEIEVMKMIMPLIAAEDGIAQFIKQPGATLEAGDILGILSLDDPSRVHHAKPFDGQLPALGLPSIVGNKPHQRFAYLKDVLSNILMGYDNQAVMQSSIKELISVLRNPELPYGEANAVLSTLSGRIPAKLEQTLRQYIDQAHESGAEFPSAKCRKAIDTTLEQLRPAEAQTVRNFLVAFDDIVYRYRSGLKHHEWSTLAGIFAAYAETEKPFSGKDGDVVLELRDAHRDSLDSVVKIVLSHYKAASKNSLVLALLDIVKDSDAVPLIEQVVSPALKDLADLDSKATTKVALKAREVLIHIQLPSLDERLGQLEQILKASVTPTVYGEPGHDRTPRGEVLKDVIDSRFTVFDVLPSFFQHQDHWVSLAALDTYVRRAYRSYNLLNIEHIEADAAEDEPATVAWSFRMRKAASESEPPTPTTGLTSQRTASYSDLTFLLNNAQSEPIRYGAMFSVRSLDRFRQELGTVLRHFPDSNKGKLQQQPAASSSQEQWNVINVALTVPASAQVDEDALRADFAAHVNAMSAEIDARGMRRLTLLICREGQYPSYYTVRKQDGTWKELETIRDIEPALAFQLELGRLSNFHLEPCPVENRQVHVYYATAKGNSSDCRFFVRALVRPGRLRGNMKTADYLVSEADRLVTDVLDSLEVASSQRRAADGNHISLNFLYSLRLDFDEVQAALAGFIDRHGKRFWRLRVTGAEIRIVLEDAQGNIQPIRAIIENVSGFVVKYEAYREVTTDKGQVILKSIGPQGALHLQPVNFPYPTKEWLQPKRYKAHVVGTTYVYDFPDLFRQAIRKQWKAAGKTAPAELLVAKELVLDEFGKPQEVARPPGTNNIGMVGWIYTIFTPEYPSGRRVVVIANDITFKIGSFGPEEDRYFFAVTQLARQLGLPRVYLSANSGARLGIAEELVDLFSVAWVDSSRPEKGFKYLYLTAEKLGELKNKGEKSVITKRIEDEGETRYQITDIIGLQEGLGVESLKGSGLIAGETSRAYDDIFTITLVTARSVGIGAYLVRLGQRAVQVEGQPIILTGAGALNKVLGREVYSSNLQLGGTQIMYKNGVSHLTAANDLEGVLSIVQWLAFVPEHRGAPLPIMPSPVDPWDRSIDYTPIKGAYDPRWFLAGKTDEADGRWLSGFFDKGSFQETLSGWAQTVVVGRARLGGIPMGAIAVETRTIERVVPADPANPLSNEQKIMEAGQVWYPNSSFKTGQAIFDFNREGLPLIIFANWRGFSGGQQDMFDEVLKRGSLIVDGLSAYKQPVFVYIVPNGELRGGAWVVLDPSINAEGMMEMYVDETARAGVLEPEGIVEIKLRKDKLLALMDRLDPTYHALRVKSTDASLSPADAAQAKTELAAREKQLMPIYQQVALQFADSHDKAGRILSKGCAREALEWSNARRYFYARLRRRLAEEAAVKRLGDADPTLSRDERLAIVHDAVGQGVDLNNDLAAAAAFEQGAAAITERVKLARATTVASTLAQLAQDDKEAFAASLQQVLGDKLTAADLARILA

SEQ ID NO: 184 - protein, 2326 aa, Phytophthora infestans
MTGHSTTGAAGETTPDTQNMVAEEAPPAADVAAYAETRSDSNPLNYASMEEYVRLQKGTRPITSVLIANNGISAVKAIRSIRSWSYEMFADEHVVTFVVMATPEDLKANAEYIRMAEHVVEVPGGSNNHNYANVSLIIEIAERFNVDAVWAGWGHASENPLLPDTLAQTERKIVFIGPPGKPMRALGDKIGSTIIAQSAKVPTIAWNGDGMEVDYKEHDGIPDEIYNAAMLRDGQHCLDECKRIGFPVMIKASEGGGGKGIRMVHEESQVLSAWEAVRGEIPGSPIFVMKLAPKSRHLEVQLLADTYGNAIALSGRDCSVQRRHQKIVEEGPVLAPTQEVWEKMMRAATRLAQEVEYVNAGTVEYLFSELPEDNGNSFFFLELNPRLQVEHPVTEMITHVNLPAAQLQVAMGIPLHCIPDVRRLYNKDAFETTVIDFDAEKQKPPHGHVIAARITAEDPNAGFQPTSGAIQELNFRSTPDVWGYFSVDSSGQVHEFADSQIGHLFSWSPTREKARKNMVLALKELSIRGDIHTTVEYIVNMMESDDFKYNRISTSWLDERISHHNEVRLQGRPDPLMVVLVGAVCCAYQASNALQEEYVSQIERGQLPHNDMLSQEESLELIYEGIKYNIEACRSGPIQFTLFCNDSYVQVEIRTLSDGGFLVLLNGKSHVAYATKEAQGLRLVVDSHTCVFTKEYDPTRLVTNTAGKLARYLVDDGASLRRGMPYAEIEVMKMYMPLLTPEAGVIRLLKSEGAVLAPGDCIATMELDDPSCVKKSDVFMGKLPSAENTNGSSTKSVHKMRKSLAVLKCVLQGYYAPEDLTQKALVDLFQVLNEPLLPVEEIREAMSSLAGRIPLDVFAKITDKIQTFKKAVAEDPTAAHEFNAAEIADILDEHKKTLDTDRKRSDFEASVVALRDITTKYKHGLASGEEAVLTELINEYFTVETVYANSHNIEDVVMALRQQNSADLNKVFSIARSHKALEAKNKLLLQLLAQMARGTAVTPRKSMKSASFVPLLEKLATFKEKQYSLVALEARQLLIDNKMPSYRDRLSQVEKVLKDYIANGSSTNLAEACANLLDQSQPLFDLLISLLDHEDQKIRELALELYALRVYRSYLIESMETMSFNDIFAKTFQFKSPVVDALAVGVAPAESYDDLASLLRRNSSASSLDLGEQNSEESSEEQEPAEKPLAKPVESYQKISPSFERHGAIARLANLETFQKSFTDVMSLFPLAKKTLSVRKDPLVNVLHVILVDEHSEESKLLEQAEAYLKSVDVDLRAHNIRRVTFSVRPQNIEDISVHNADMALYPNIYTFPGRMNYSEDKILRHMEAPLAYKLELRRLQNYSVTPLASENKNVHLYLAKMKDSDAHIITDRFQRIFVRAVVRQLDHDGSGSRSQYDAYPGPERSLVDALNALEVNLSNPLVKKSSLPTKNNHVYLNILPQAIVDPQYLEGVIRILAYRYAERLEQLGVSTVELKIIARFNSEAPAIPVRLVAENPTGYVVRVQAYVEAAGHDEPIFTSIGDETHGELDGMPVTTPYPVVFPFDKKRQMAKAMSNTVYVYDFLELIEYNLLRQWRKYVQQRTRGGGSKITIPNLLMETRELILDATGKALTETTRLRGQNDIGMVAWLLTLYTPEFQDGREIIIIANDITFKAGSFGTREDTLFDLASKLARSKGIPRFFFSANAGARIGMAESIKALYKVCWKDETNPIKGFEYLYLTPEDYKVASAEGSVNAKLLVTSTGEERYVLNDIVGREIDLGVECLRGSGTIAGETSRAYQDVFTLTYACGRSVGIGAYLVRLGQRTVQNATHSPIILTGYQALNKLMGKDVYTSNDQLGGVKIMHTNGVTHLTAKNHLSGIYSILEWLSFVPAVRRGPLPIRDLTGVDEIERTVDFCPADKSTQYDPRALLAGKVDEATGKWVSGLMDKDSFRETLDGWAKSVIVGRGRLGGIPCGVVVTEVRTSEKVIPADPASPASQENLMQQAGQVWFPDSAHKTATAIKDFKGEDLPLFILANWRGFSGGQRDMFDEVLKFGAAIVDGLVNYEQPVFVYIPPFAELRGGAWAVVDPTINEGIMEMYADPQGRGGVLEPAGLIEIKYRKKQLLQTMHRLDDKLKQLTARLGELSPEEKATEGAKISAEIKTREETLLPIYVQVATEFGDLHDTPGRMKSVGCIRQVVPWSNSRRFFYWRLKRQLAEFTLRRQVVAASAGGPRATTFVGSEQVLKGWFTEAVNGGRVPRQQNVSVSELWSHGDSDVLLWLSSDKEWIASRVAELRQEQMASQVVEIGRKDPKAAVAGILEVLNLLSDKDREEALNALRRGSIFHK

SEQ ID NO: 185 - protein, 2202 aa, Theobroma cacao
MSEAQRKSAMAGVGRGNNGYTNGVLLMRSPATISQVDEFCFALGGKKPIHSILIANNGMAAVKFIRSIRTWAYETFGTEKAILLVAMATPEDMRINAEHIRIADQFVEVPGGTNNNNYANVQLIVEMAEITHVDAVWPGWGHASESPALPDALNAKGIIFLGPPAVSMAALGDKIGSSLIAQAAEVPTLPWSGSHVKIPAESCLVAIPDEIYSKACVYTTEEAILSCQVVGYPAMIKASWGGGGKGIRKVHNDDEVRALFKQVQGEVPGSPIFIMKVASQSRHLEVQLLCDQYGNVAALHSRDCSVQRRHQKIIEEGPITVAPLETVKKLEQAARRLAKCVNYVGAATVEYLYSMDTGEYYFLELNPRLQVEHPVTEWIAEVNLPAAQVAVGMGIPLWQIPEIRRFYGMEHGGGYDSWRKTSVVTTSFDFDKAESTRPKGHCVAVRVTSEDPDDGFKPTSGKVQELSFKSKPNVWAYFSVKSGGGIHEFSDSQFGHVFAFGESRALAIANMVLGLKEIQIRGEIRTNVDYTIDLLHASDYRENKIHTGWLDSRIAMRVRAERPPWYLSVVGGALYKAAASSAAMVSDYVGYLEKGQIPPKHISLVHSQVSLNIEGSKYTIDMVRGGPGSYRLKMNESEIEAEIHTLRDGGLLMQLDGNSHVIYAEEEAAGTRLLIDGRTCLLQNDHDPSKLVAETPCKLLRFLVSDGSHVDADTPYAEVEVMKMCMPLLSPGSGVIQLKMSEGQAMQAGELIARLDLDDPSAVRKAEPFHGSFPVLGPPTAISGKVHQKCAASLNTACMILAGYEHNIDEVVQSLLTCLDSPELPFLQWQECLSVLATRLPKNLKNELESNHKGFEAISSSQNVDFPAKLLKGVLESHLSSCPEKERGSLERLIEPLMSLVKSYEGGRESHARVIVRSLFEEYLSVEELFSDNIQADVIERLRLQYKKDLLKVVDIVLSHQGVKSKNKLILRLLEQLVYPNPAAYRDQLIRFSALNHTSYSELALKASQLLEQTKLSELRSTIARSLSELEMFTEDGESMDTPKRKSAINERMEDLVSAPLAVEDALVGLFDHSDHTLQRRVVETYVRRLYQPYLVKGSVRMQWHRSGLIASWEFLEEHIERKNGSEEKMSDKPLVEKHGEKKWGAMVIIKSLQFLPAIINAALRETTHNLHEATPNGCAEPSSFGNMMHIALVGINNQMSLLQDSGDEDQAQERINKLAKILKDKEVGSSLRSAGVGVISCIIQRDEGRTPMRHSFHWSAEKLYYEEEPFLRHLEPPLSIYLELDKLKGYENIQYTPSRDRQWHLYTVVDKPLPIQRMFLRTLVRQPTADDGLTAYRGLDVDMIRSQWAISFTSRSILRSLMAAMEELELNVHNATLKSDHAQMYLCILREQQINDLVPYPKQIYRELEDTSKHRVVYHSLSVRGPLHGVPVNAHYQTLGVLDRKRLLARKNNTTYCYDFPLAFETALQQSWASQFPGIKKPKDKLLPKVTELIFADQKGNWGTPLVPVERQPGLNDVGMVAWCMEMSTPEFPSGRTILIVANDVTFKAGSFGPREDAFFLGVTDLACTKKLPLIYLAANSGARIGVAEEVKACFKVGWSDESSPERGFQYVYLTPEDYARIGSSVIAHEIKLASGECRWVIDTIVGKEDGLGVENLTGSGAIAGAYSRAYKETFTLTYVTGRTVGIGAYLARLGMRCIQRLDQPIILTGFSALNKLLGREVYSSHMQLGGPKIMATNGVVHLTVSDDLEGVSAILNWLSCIPTHIGGPLPILNPSDPPERPVEYFPENSCDPRAAICGALESSGNWKGGIFDRDSFVETLEGWARTVVTGRAKLGGIPVGVVAVETQTVMQVIPADPGQLDSHERVVPQAGQVWFPDSATKTAQAIMDFNREELPLFILANWRGFSGGQRDLFEGILQAGSTIVENLRTYKQPVFVYIPMMGELRGGAWVVVDSRINADHIEMYAERTAKGNVLEPEGMIEIKFRTKELLECMGRLDQQLISLKANLQEAKISGAYAKMESLQQQIRTREKQLLPVYTQIATKFAELHDTSLRMAAKGVIKEVVDWDRSRSFFYRRLCRRIAESSLVKIVKDAAGDQLSHKSAMDLIKKWFLDSNIAKGSEDAWVNDEAFFSWKDDQRNYSEKLQELRVQKVLLQLTNIGNSASDMQALPQGLAALLSKVNHPTILSCFYSILVYISRNL

SEQ ID NO: 186 - protein, 2123 aa, Ostreococcus tauri
MQIAMPTTTASAAAHAVSIRSSKNKVLGDVRRGISARASVRRADSTRRIAVARATNRDVHVVRAIADSSPSTSELSSADALAKYVAERGGKRVIRKVLIANNGMAAAKSILSMRRWAFNEFGDENAIQFLAMATPEDLGANAEFIRYADDYVEVPGGSNKNNYANVPLITEIAKREGVDAVWPGWGHASENPKLPTALKAIGVQFIGPTAPVMSVLGDKIAANILAQTAKVPSIPWSGDGLVAELTAEGTIPEETFNKAMVTTVEECVAAAKRIGFPVMLKASEGGGGKGIRMSADEEQLRVNFEQVKAEVPGSPMFMMQLCTQARHLEVQIVGDEYGNAIALNGRDCSTQRRFQKIFEEGPPTVAKKDVFREMEKAAQRLTKNIGYIGAGTVEYLYNAETDKYFFLELNPRLQVEHPVTEGITGVNLPATQLQVAMGIPLSRIPEIRRFYGRDIDSTDDIDFMEEDYKYPETHVIAARITAENPDEGFKPTSGGIERISFQSTPNVWGYFSVGANGGVHEFADSQFGHIFASGRNRNEARKALILALKGMVVRGEIRTAVEYLVQLLETDEFKANTIDTSWLDGLIAKKQIANKQDEHMIVLGAAIFRAFNMAKTEEAAFTEFWQKGQVSVQGVDKMIRFPIEITYNDVKYSFQITRPGPDIFLVSTPEGQSIEAKIRERADGALVAIFGGEQHEIEGLEEPLGLRMILDGQTWLLPTVFDASELRTDVTGKLIRFLQDDGAEVVAGKPYAEVEAMKMVMPLVATESGKINHAKAAGAVIEAGDLLASLTLKDPSKVKKITTHSGALRLPVCDEAPPGPEEALNAAIGRVNLFLDGYELDANQCVSDLLSSLTSLPADQGRWERATDVLDQIIQRYLSVESVFEGKKLDAVMQQLIRANSSNLQPVLDQVRSHMRSKERQGLILSLLKQAPTLPQRVMSRGPISWADDHAPISDSLRKNIERLSKLRGGEYGDIAVQASNILLERRLPSIDKRLDELKKILLGSQPLLRSWSIGGKAPLPGDLQSLVESPTLAVDLLPSLFSDKDEKVQNAALEVYCKRVYRAHNVLSTSVSRDNGMTSISWNFKFNTFPDESPLRCGMLARVDTVADAKQNFSAMLDRLESNVKAAGAGGSSDTQLHVLHVAVCKQSADDGLPTDLEAFIASHKDRLNAMGIKFVNFLAYSDLELPAYFTFHSGKDFKEDMLYRGERPTVAHLLELARLENFKLTRLPTVNRDLHMYVGETSANVGKRGPAKHLLLRRLSHSKDMMDGGLERVLGKALEAVSLSLVDSRAKGVSSSRLYVNFLPVFEDLNFNTAVATMKSKLTDYISRESAQLLAKKVDEIEVRFRVGKEKVPLRLMATSMSGQWLKVDLYKEYLESTSGKAEQFCLLGPNGEEESCFLEPYPQPGALAQKRAVARAIGTTYIFDFLGLFEKALVLDWRTHIADVGGTMPSDFFSASELVLGNDGQLTKEQRPAGSNNVGMVGWHCFMKTPEYPEGREVVIVGNDCTYMSGSFGVKEDDVYDAISKYARKLGLPRVYIASNSGARIGLVEELKPYFKVAWTDASNPGLGYKYLYLTPEDYKSFPEGTVKAEEVKEDGEIRMKLTDIIGQIHGIGVENLRGSGMIAGEQSAAYADAFTLSYITGRSVGIGAYLCRLGQRNIQMTNGPLILTGYLALNKLLGREVYTSQDQLGGPQVMMPNGVSHLQVADDQEGVRSILNWLSYTPATSKSQVRARRSSDPVDRDIDFMPSKTPYDPRNMLAGVEQNGSFAKGFFDTDSWTETLPDWGKSVVTGRARLGGVPCGVIAVETRMMEQRIPADPANPESREAVLAQAGQVWFPDSAHKTATAIRDFNNAENLPLFIFANWRGFSGGTRDMYGEILKFGAMIVDELRVYRHPVFIYIPPNGELRGGAWVVVDPTINEGRMEMYADVESRGGILEPPGICEVKFRPKDQLAAMHRLDPVLMELDKDAEANKDEIKKREQNLLPMYTQVAHEFADLHDRSGRMKAKGVIRDVVEWKNARRYFHGRLTRRLAVDALASKIKSELGDIKLDRPVEEYIEEAVAASGVNANDDNAVAAMLESNSAKIGNDVMIKGRAAKVAQYVEKLKGLDAEDLKAILAQM

SEQ ID NO: 187 - protein, 2139 aa, Nannochloropsis gaditana
MASFPPSNRRATPARVMVVIFSSVLILLAGPVGDAWRMPSIAPGQSTGVAKTSRWAGFLGNFARRSPSISTSPSLPPSLPASSLGPLSAATMAPPSTLSPAAQKKKDAVAAYVKSRGGNLGIRKVLIANNGMAATKSILSIRQWAYMELGDDKAIEFVVMATPEDLNANAEFIRLADRFVEVPGGSNKNNYANVDLIVQVAEREGVDAVWPGWGHASENPRLPNTLKEMGIKFIGPTGPVMSVLGDKIAANILAQTAKVPSIPWSGDGLTAELTAEGTIPDETFQKAMVRTAEEALAAANRIGYPVMLKASEGGGGKGIRMSNNDEELKNNFVQVSNEVPGSPMFMMQLCTQARHIEVQIVGDEHGNAAALNGRDCSTQRRFQKIFEEGPPTIVPPEVFKQMELAAQRLTQSIGYIGAGTVEYLFNAATGKYFFLELNPRLQVEHPVTEGLSLVNLPATQLQIAMGIPLNRIPDIRRFYGKEDPYGDSPIEFFEDDYADLASHVIAARITAENPDEGFKPTSGRIERVKFQSTANVWGYFSVGANGGIHEFADSQFGHLFAKGKTREDARKSLVLALKEIEVRGDIRTTVEYLVQLLETDAFKENTIDTSWLDGLIREKSVRVELAPHEVALSAAIARAFARSQEEEKKFVENLGKGQVSIQSIRSINSFPMEITYKDSKYSFLCSRIGPDKLRLTINGQVLETKVRQQPDGSLIAEFGGTTHTIYALEEPLGLRMVLDGVTVLLPTVYDPSELRTDVTGKVVRYLQDDGAEIQAGQPYVEVEAMKMIMPLKASESGTVTHRLSPGSIITAGDLLANIQLKDPSKVKKIIPFKDTLELAGSGEEPGTTEIESVLKTMNLVLDGFDYEVEFLAQNLVTSVRDGKELLDAAVALVSKYLAVEEQFAGKALDEAMVALVKANKESLGTVLQLATAHRELPRRNKMVSALIRQLQALVERPGTSELALGPLIDLLERTSHLPGKEYGEVAISSAQALLALKAPPFNIRKDELRATLMQTQDNDALARSATLTAGVDLLTAMFTDPDVTVRKNAIEVYIRRIYRAHRILSLSVEEVDGVMVARWSFKFADTPDEESPLRYGFFTVFPSLEAYTEGTEKFSKVLKSSLGGKEVYSEPTNVFHVAVAQLPESDQPEVIANIEAILAEKKELLTECQVRMVNVLFVKGASNPRYYTFTAAENFKEDPLRRDMRPTFPQLLELSRLAANYELQRLPSIGRNTQVYLGTERAAAGVKKRGGSQVLFVRGISHSEQTQTPLGAERVLLMAMDELDYALLDPRVGGSASSRLFLNLLVPITTDPEALAGEWNQVMDRLLAKYATRLLKLGVDEIEIKVRVTADGNTITPVRLMATSMTGEFLRTDAFLEYPDPVNGITKQFCSITREDQICLLNPYPASNSIQTRRASARRIGSTYAYDFLGVMEVSLIQKWDKHLKELSSVYPSRVDDKMPEQLFTAHELVLEDDELQPTQRLVGLNDIGMIAWHATMKTPEYPEGRELVIIANDVTFQSGSFGVKEDEFFRAASEYARVRGLPRIYLSSNSGARIGLVDDLKGKFRIAWNDPANPSLGFKYLYLPPEEYEALKPGTVNANLVETEEGEKRWALQDIVGQVHGIGVENLRGSGMIAGETSRAYDETFTLSYVTGRSVGIGAYLVRLGQRTIQMVNGPLILTGYSALNKLLGREVYTSQDQLGGPQIMAPNGVSHLVVGNDKEGVSSIIDWLSFVPKDKFSAPPILDLPTDSPERDVEFLPTKTPYDPRHMLAGTVGPDGAFVPGFFDRGSFIETLGGWGKSVVTGRAKLGGIPMGVISVETRLVEQRVPADPANPDSRESILPQAGQVWYPDSAFKTAQAMEDFNRGENLPLIIFANWRGFSGGTRDMFGEILKFGAKIVDALRTYRHPVFVYIPPNGELRGGAWVVIDPTINEEMMEMYADKDSRGGILEPPGICEVKFRNADQVSAMHRLDPVIQALDGELQNAKTEQDAAKLTQQLKEREEALLPLYTQVAHEFADLHDRAGRMKAKGVIRDVVTWKRSRSYFFWRARRRIAEDGLIREMQRVDPTLSVQQGREKVSALASPAVYEDDKAFVAWVEEGGEAIAKELEKIKQAAVKASLASLLEGLSAEERKQVLAGL

SEQ ID NO: 188 - protein, 2282 aa, Dictyostelium discoideum
MIEINEYIKKLGGDKNIEKILIANNGIAAVKAIRSVRKWAYTNFGNERAIKFVVMATPEDMKANAEYIRMADQILQVPGGSNNNNYANVDIIVDFAERAGVQAVWAGWGHASENPRLPDLLSKTETGIVFIGPPAKAMADLGDKIASTIVAQSARVACVPWSGSGLKVDYSECNGVPSEIYGRACINSVEEARECAQRVGFPAMIKASEGGGGKGIRKVTSMEDLESSFRQVQNEVPGSPIFFMKLVSNARHLEVQIVADRHGEAISLNGRDCSVQRRHQKIIEEGPAIAPTPQVWEEMERAAVRLVKEVGYVGAGTVEYLFAEGEYYFLELNPRLQVEHPVTEQITGVNLPATQLQIAMGIPLHRIPDIRKLYGRTGDDLYGDSMIDLHDFTKRNPPAGHCIAVRITGENPDEGFKPTSGQIHELTFRSTPNIWGYFSVGAKGGLHEYADSQFGHIFANGATREEARKTIILGLKEISIRGDIRTPVEYIIHLLESKDFKENHIHTGWLDQLISEKIQTKKPETMIVVLCGAIYKASTIFSTKIQEFSNQLSNGQLPSLELLNNSLPIELIYNNVKYQFEVSRTGINNYSVCLKNDKSAVSIDSSVIMLSDSGLLILLNGSTHVCYGREDVIGLSLMIDSKTCVFSQEYDPSILRTSSPGKLVRYLVDDGSLVVKGTPFAEIEVMKMYMPLLVPEKGIIKFVLTEGSVMAPGAIIANLELSDQSSIQKSTVFTGSLTKMSPPTLIGNKPHQLLNYTLGKISNVLCGYESNDLNQLLNDTIKQLSNQKLPLFEFKEQLSIVQSRIPQSLFKLINDELNKFEFNNDDDDEDDSELFNSKNLQLSISLYLNKLLLENEQLSIAIQLLIKPIILLAEKYNDGVSFAAINIFKNYLEEFIQIETNLQNKNIQTVLKSIRPTYKDNISKVVDIAQSLHPQSKKYKFILLLLNKIQEQGLVCDFVEQFKKLSSLGGNCMEISLKAKHIMVHSQLPSNKQRSNDLINSLKSILNVNNEQQQQVDEKVQDNKDEKISKLSKQTNEISDILIPMFFNESNNDDDIRKLAMEVYVRHSYRSYYVEDTKVTLSNDEGSSGFSFIEWHFYINLPQQSNLGGSNSGSPTYGSPLIRSISSSGGSSGGSGFQISPRPSMSIFNGLSMLRTDSTDSLTAMEDQTKLRYGMMVFFENEKKFEEKLPLILTRYNEENNKKSQLSLSPNESTDILSVIISIYPESISQENQAISSFQSILKGYIKELSIARIRRITFICCGGDEGKPLKYFTFRERHMYMEDPIFRHIEPAMAYHLEVRKLSNFDITHVPTTSQRIHLYYAQEKGKKETDPDADRSFFVRSVIRYSDLYGHSNEIKVDILLSQIETLLSESIESLEIAMSNKKYEKAQNHSIFLNVMPEVMFDEKMIGYVVQEIGDRLGKRLWKLRVGRVEVRGRIRKGDGLIPVRFFVQNPTGYAFQVQCYYEQQNSIGQMVFAVVPGSSKGSWEGLPVDTPYPIMDAVQRNRFKAQRLDTTYCYDYPDLFREAMQNIWMEFMESNKTNPVKVYPSSRGVLESVELILPSTINTDFPPSIPLDQLPEESKPKLEETYRPIGYNDIGMVAWRMTFYTPEYPLGRQAIVIANDITHQIGSFGPQEDMLFKLASELARKEKIPRIYLSSNSGARIGLADEIKSKFKVTWNVPSDPTKGIKNLYLTNNDYQALKDSVIAYQDTTDKDKWIIHDIIGQKNGIGVENLSWSGLIAGETSQAYNEIFTITLVSGRSVGIGAYLVRLGQRTIQNDAPIILTGASALNKVLGKEVYESNQQLGGSQIMYPNGVSHIIVNDELRGITNVLQWLSFVPKSGGEMVPIISPIDSPHRDIEFDPSNSINGKCDTRHLIAGLQSELDPNYWISGMFDKDSFMETLAGWANTVITGRARLGGIPVGIIAVETKSVEKIIPADPANPLSYEQVNTQAGQVWYPDSSFKTAQAIADFNNGEELPLMILANWRGFSGGMRDMFDEILKFGSMIVDNLRNYKQPVMVYIPPFAELRGGAWVVLDSTINLDMMEMYCSEEGRGGVLEPNGIAEIKYRDPELIKTMHRLDPKLIEWDKSIPIGVSVNGLDQSQKTIKSQIQQREKELLGIYQQIAIKFADLHDTPGRMKAKGVIKQMVPWKSARSFFYDRIKRRLFEEDKLKLIDKSHPGLNRQSKLNLLETWIKQILGNNQSVDYHQNDKLISSTIESNSHIINDKIIDLSKQYAINQILNFVQSDSESIVDGFQNLLPFISTQQKEFLFESLKKDLNK

SEQ ID NO: 189 - protein, 2541 aa, Musca domestica
MLLTLIITLSFIVTLVAYARRRQQQHYIHKSPSILTTTPPPSPPPQPSQENCTKELNSSASTGRIKKVQFSSDSFKVEEDDDHNTICDSVNCLNLDDKQLENNHNHQQEEQQETLDNCDTKNNLRLILNNNNIKMSNSNNERPSFLVGDENEVTNGHEAGESGDEFPQKMQNDSQRMNGDLSEKRKRLRMLKRRASKRFVLDQTCDQQPDGGNAGTNASAASSTATSNGTALPDVNISMADNCQTEQEQQQQQPTSPPAPTENVDQNSNKTYLTPNTGTTPTIKPSMSRGTGLGQDRYQDRDFHIATPEEFVKKFGGTRVINRILIANNGIAAVKCMRSIRRWAYEMFKNERAIRFVVMVTPEDLKANAEYIKMADHYVPVPGGSNNNNYANVELIVDIALRTQVQAVWAGWGHASENPKLPELLHKENLVFLGPPERAMWALGDKVASSIVAQTADIPTLPWSGSELKAQYSGKKIKISSELFNRGCVSNVEQGLAAVNKIGFPVMIKASEGGGGKGIRRVDTAEEFPALFRQVQAEVPGSPIFVMKLARGARHLEVQLLADQYGNAISLFGRDCSIQRRHQKIIEEAPAIVAHPEIFEDMEKAAVRLAKMVGYVSAGTVEYLYDAEGKYFFLELNPRLQVEHPCTEMVADVNLPACQLQIGMGIPLYRLKDIRLLYGESPWGTSVIDFENPPNKPRPSGHVIAARITSENPDEGFKPSSGTVQELNFRSSKNVWGYFSVAASGGLHEFADSQFGHCFSWGENRQQARENLVIALKELSIRGDFRTTVEYLITLLETNSFLDNTIDTAWLDALIAERVQSEKPDILLGVMCGALHIADRQITEAFNSFQTSLEKGQIQAANTLTNVIDVELINGGIRYKVQAAKSGANTYFLLMNNSFKELEVHRLSDGGMLLSFDGASFTTYMKEEVDRYRIVIGNQTCVFEKENDPSLLRSPSAGKLVNLLVEDGAHVNKGQAYAEIEVMKMVMTLTSQEAGTVSFVRRPGAVLDAGSLLGHLELDDPSLVTKAQPYKGQFPQPENPPVPEKLNRVHNTYKTILENTLAGFCLPEPYNAQRLRDVIEKFMQSLRDPSLPLLELQEVIASISGRIPISVEKKIRKLMTLYERNITSVLAQFPSQQIASVIDFHAATLQKRADRDHFFLTTQGIVQLVQRYRNGIRGRMKAAVHELLRQYYDVECQFQHGHYDKCVGLVRERNKDDMQTVVNTIFSHSQVAKKNLLVTLLIDHLWANEPGLTDELAHTLNELTSLNRAEHSRVALRARQVLIAAHQPAYELRHNQMESIFLSAVDMYGHDFHPENLQRLILSETSIFDILHDFFYHSNRAVCNAALEVYVRRAYTSYELTCLQHLELSGGLPLVHFQFLLPTAHPNRLYSRMSHDGVEGGPENVSNTFLRTGCMSAFDSFEHFEMYSDEILDLLEDLASPAFVSAKVLEAVDAVDSMSDGRLSTSINVSLSDPITRANAAEEAKSTEPIHIISVAVRETGDMDDVQMAQIFGNYCKTHREELLQRRIRRITFAALKKRQFPKFFTYRARDNFEEDRIYRHLEPACAFQLELNRMRTYDLEALPTANQKMHLYLGRAKVSQGQEVTDYRFFIRSIIRHSDLITKEASFEYLQNEGERVLLEAMDELEVAFSHPHAKRTDCNHIFLNFVPTVIMDPAKIEESVTKMIMRYGPRLWKLRVLQAELKMLIRQSPQASTQAIRLCIANDSGYFLDISMYTEQTDPLTGIIKFKAYGDKLGSLHGLPISTPYMTKDFLQQKRFQAQSNGTTYVYDIPDMFRQMTERHWKEFSKARPTVDVRIPEKILIECVELVLEGDNLVEMKRLPGENTCGMVAWRIILATPEYPEGREMIVIANDLTYFIGSFGIQEDIVFHKASQLARERKVPRIYISVNSGARIGLAEEVKSMFRVAWEDPEEPEKGFKYLYLTTEDYSKVAHLNSVRAILIEDEGEPRYKITDIIGKDDGLGVENLRYAGLIAGETSQAYDEIVTISMVTCRTIGIGSYLVRLGQRVIQIDNSHIILTGYAALNKLLGRKVYASNNQLGGVQIMYNNGVSHKTEALDLDGVYTILDWLSYMPAYTGGDLPIVTPNDRINRAVDFMPTKSPYDPRWMLAGRVNPANASEWENGFFDRDSWSEIMAPWAKTVVTGRARLGGIPVGVIAVETRTVEVEMPADPANLDSEAKTLQQAGQVWYPDSSYKTAQAIKDFDREELPLIIFANWRGFSGGMKDMYEQIVKFGAYIVDGLREYKKPVLIYLPPNAELRGGAWAVLDSLINPRYMESYADPEARAGVLEPEGIVEIKYKEKDLVKTIHRLDPTTIGLKKQMDEALAAGDKVKASQINEKIKERIEAMIHVYHTVAVHFADLHDTPERMLEKGCINEIVPWRESRTWLFWRLRRLLLEDAFIKKIIHAQEGLSVGQAKQMLRRWLVEDKGTTESYIWDKNEEMVQWYLEQLKPDSIVSGNINAVRKDAIISAITKMLEDCPDVTLDAVVGLCQNLSPVNRGVVVRTLAQLQLNEQQPSGNQG

SEQ ID NO: 190 - protein, 2346 aa, Sus scrofa
MDEPSPLAKPLELNQHSRFIIGSVSEDNSEDEISNLVKLDLLEEKEGSLSPASVSSDTLSDLGISSLQDGLALHMRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWHENDFSKRILNVPQDLYEKGYVKDVDDGLKAAEEVGYPVMIKASEGGGGKGIRKVNNADDFPNLFRQVQAEVPGSPIFVMRLAKQSRHLEVQILADQYGNAISLFGRDCSVQRRHQKIIEEAPAAIATPAVFEHMEQCAVKLARMVGYVSAGTVEYLYSQDGSFYFLELNPRLQVEHPCTEMVADVNLPAAQLQIAMGVPLYRIKDIRMMYGVSPWGDAPIDFENSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQLNRIDTGWLDRLIAEKVQAERPDTMLGVVCGALHVADVSLRNSISNFLHSLERGQVLSAHTLLNTVDVELIYGGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAAESGCIHYVKRPGAALDPGCVIAKMQLDNPSKVQQAELHTGSLPQIQSTALRGEKLHRVFHYVLDNLVNVMNGYCLPDPFFSSRVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNAFTPPCQRMGGMVSFRTFEDFVRIFDEVMGCFCDSPPQSPTFPEAGHTSLYDEDKVPRDEPIHILNVAIKTDCDIEDDRLAAMFREFTQQNKATLVEHGIRRLTFLVAQKDFRKQVNYEVDQRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAYLPPPPLPSDMLTYTELVLDDQGQLVHMNRLPGGNEIGMVAWKMSLKSPEYPEGRDIIVIGNDITYRIGSFGPQEDVLFLRASELARAEGIPRIYVAANSGARIGLAEEIRHMFHVAWVDPEDPYKGYKYLYLTPQDYKRVSALNSVHCEHVEDEGESRYKITDIIGKEEGLGAENLRGSGMIAGESSLAYNEIITISLVTCRAIGIGAYLVRLGQRTIQVENSHLILTGAGALNKVLGREVYTSTSQLGGIQIMHNNGVTHSTVCDDFEGVFTVLHWLSYMPKSVCSSVPLLNSKDPIDRVIEFVPTKAPYDPRWMLAGRAHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQMLKFGAYIVDGLRECSQPVMVYIPPQAELRGGSWVVIDPTINPRHMEMYADRESRGSVLEPEGTVEIKFRRKDLVKTMRRVDPVYIHLAERLGTPELSTAERKELESKLKEREEFLLPIYHQVAVQFADLHDTPGRMQEKGVINDILDWKTSRTFFYWRLRRLLLEDLVKKKIHNANPELTDGQIQAMLRRWFVEVEGTVKAYVWDNNKDLVEWLEKQLTEEDGVRSVIEENIKYISRDYVLKQIRSLVQANPEVAMDSIVHMTQHISPTQRAEVVRILSTMDSPST

SEQ ID NO: 191 - protein, 2261 aa, Ciona savignyi
EKNASLPTTSSSNTSLSGVNKNPMRKQLSRKSSRSVAATIPELVKILGGNNVIEKILLANNGIAAVKCMRSIRRWAYEMFRNEKAIHFVAMVTPEDLNANAEYIKMADSYVHVPGGANNNNYANVELILDLARRTAVQAVWAGWGPVENPKLPEMLSKANIAFLGPSASAMWALGDKIASSIVAQTAGVPTLPWSGSGLSVPYNPPEEQQSGDSTLGEVSTINVPDDIYQQGCVHGVENAMNTAQRIGYPVMIKASEGGGGKGIRKVTSPDDLPAALRQVQSEVPGSPVFIMKLATQSRHLEVQVLADQYGNAISLFGRDCSIQRRHQKIIEEAPTTVTSEDVWSSMERDAVVLAKMVGYVSAGTVEYLYSEDGSYNFLELNPRLQVEHPCTEMIADVNLPAAQLQVAMGIPLHRMRDIRILYGEDPWSDAPIDFNRPQHKPEPHGHVIAARITSEPDEGFKPSSGTVQELNFRSSKNVWGYFSVAAAGGLHEFADSQFGHCFAWGENREYAISNMVMALKELSIRGDFRTTVEYLGRLLEDQCFQHNQIDTAWLDALIADKVKSEQPCTTVGLVCCALHIADSKYKARFDFYVNSLERGQVLTPTSLRTSEIVELISGGVKYLIKVTKTSDNGYYLECNDWNMEVDVYSLSDGGLLLSLDGISRTTYLKEEVDRYRVTINNQTSVFEKENDPSVLRGPSAGKLLNFIVEDGAHVFAGETYAEIEVMKMVMSLTTPESGTIHYVKRAGAVLEPGSVIARLVPDDPACVRKAELFQDQLLNVNGTEDLPSKEKSHKIFEVAYKRLSCIMKGLCHPDEIFADKMKEAVRILMTALKDPSLPLLELQEVMTNISGRLPAQVEKSIRREMSSYASNITSMMSQFPGSRIRRAVDSFAAKLTNKTEQDVFFVNTQPILQVINKYRNGIRGHMKTVVLGLILEYHRVELQFQHGSFDKSVVAIREKRKDNVRAVVDDILSHESVTKKNALIVELISCVSGRDHSLPQDVATVLEQLALLSKQENSKVALKARQVLIAAHQPPYELRHNQLESIFLSSIGSYGTEFCPEHLKKLILSETTIFDVLPDFFYHANPVVRMAAFEVYVRRSYIAYELNSVQHHEIGEGNCILEFQFMLPTTHPNRYFLLFTSSLPKVASVGEGLNAIDPTTLPPCQRMGIMAAFNNFDTFKLHFTSIMRCFHNASPPESPIFFEGRSVGTTHQAMIISDEPIHILNVAIATNHGVDDDSLNNQFYQFVKENKVELFETGLRRITFLVHKRKEVPKYFTYRARDLFDEDRIYRHLEPALAFQLELNRMRNFHLKAVPTNNHRLHVYLGSAKVEEGAEVMDHRFFVRAIIRHSDLVTKEASFEFLHNEAERLLLEAMDELEVAFSATENTRIDCNHIFMNFVPNVMIDPMKVEESIRSMVLRYGSRLWKLRVLQSEIKVNIRLKEDAEPQPFRIFLTKESGYYLDISLYKEVTNPITGQTMFQAYNSNKPGPLHSMLTSTPYVTKDLLQAKRFKAQEMGTTYVYDFPEMLRQALKEQWKKLKTEDEELQIPENLLVLDGQGHLVNINRQPGENEIGMVAWRLTFYTPEYRDGRQVICIANDITCSIGSFGPEEDILYLRASELARMEGLPRIYISANSGARIGLAEEVRHLFRIAWNDVDDVQKGIKYIYLTPHDYKKLSGTNSVKAQHIEEEGESRYKISDIIGKDEALGARCLRWSGTIAGETSRAYDEVVTISLVTCRAVGIGAYLVRLGQRVIQVDNSYIILTGHQALNKVGFWGREVYNSNNQLGGIQIMHNNGVSHATVSWDYEGMLLILKWLSYIPSTRNSPLPIIEAKDSIDREISFHPSRACYDPRHMLAGCNDPETDTWKSGFFDRDSFDEILSGWANTVIVGRARLGGVPVGVVAVETRSIAVDIPADPGDIESEEKTLHRAGQVWYPDSAFKTAQAILDFNREGLPLIMFANWRGFSGGMKDMHDEVLKFGSYIVDALRKYHQPVIVYIPPFAELRGGAWVVVDPTINSSHMELYADEESRGGVLEAQATVEIKYRKKELVKTMKRCDQQYAAISQELEKSSLSLKEKKQLQAKLKEREEYLEPIYHQVAVKFADLHDTPGGMLAKGCLSGILTWKTSRNFLYWRLRRLLLQDDVKSRCHGANRDLTNAQIDVMIRRWFVEDQGTVKAHLWDDNEAVVTWLLSQLSSSKENGVSLLEENIKLLQRDSVSQQIRVLSQNSPEVAMHSVVQLAQQMSPEQRQEVIKVLESLEA

SEQ ID NO: 192 - protein, 1220 aa, Chloroflexus aurantiacus; identical to SEQ ID NO: 108

SEQ ID NO: 193 - protein, 1219 aa, Chlorocrinis aggregans; identical to SEQ ID NO: 109

SEQ ID NO: 194 - protein, 1221 aa, Oscillochloris trichoides; identical to SEQ ID NO: 112

SEQ ID NO: 195 - protein, 1229 aa, Roseiflexus castenholzii; identical to SEQ ID NO: 113

SEQ ID NO: 196 - protein, 1216 aa, gamma proteobacterium; identical to SEQ ID NO: 111

SEQ ID NO: 197 - protein, 1231 aa, Chloracidobacterium thermophilum; identical to SEQ ID NO: 110

SEQ ID NO: 198 - protein, 1204 aa, Sandarakinorhabdus limnophila; identical to SEQ ID NO: 114

SEQ ID NO: 199 - protein, 1229 aa, Blastomonas sp.; identical to SEQ ID NO: 107

SEQ ID NO: 200 - protein, 357 aa, Metallosphaera sedula
MRRTLKAAILGATGLVGIEYVRMLADHPYIKPTYLAGKGSVGKPYGEIVRWQTVGNVPKEVANQEVKPTDPKLMDDVDIIFSPLPQGAAGPVEEQFAKLGFNVISNSPDHRFDMDVPMIIPEVNPHTVTLIDEQRKRRDWKGFIVTTPLCTAQGAAIPLTPIYQNFKMSGVMITTMQSLSGAGYPGIASLDIVDNALPLGDGYDAKTVKEITRILSEVKRNVQEPGVNEITLDATTHRIATIHGHYEVAYVTFKEDTDVRKVMESMESFKGEPQDLKLPTAPEKPIIVTTQDARPQVFFDRWAGNPPGMSVVVGRLKQVNPRTIRFVSLIHNTVRGAAGGGVLTAELLVEKGYIDKR

SEQ ID NO: 201 - protein, 359 aa, Sulfolobus tokodaii
MILMRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 202 - protein, 357 aa, Sulfolobales archaeon
MRRTLKAAILGATGLVGIEYVRMLSQHPYIKPAYLAGKGSVGKAYSEVVRWQTVGQVPKEVADMPVLPTDVNEIKKAGVDIVFSPLPQGAAGPVEEEFAKAGFPVISNSPDHRFDPDVPLMIPEVNGHTASLIDEQKKRRDWSGFIVTTPLCTAQGIAIPLAPIYRDFRVDSVFITTMQSLSGEGYPGVASLDVVDNIKVLGDAYDAKTVKEVTRILSEVKRNVPGTMDELTLSATTHRIATIHGHYEVMYVTFKEDVKVEKVKETLANFKGEPQDMKLPTAPSRPILITELDNRPQPYFDRWAGDVPGMSVVVGRLKQVNNRTVRLVSLIHNTVRGAAGGGILVAEYLIEKGYIPK

SEQ ID NO: 203 - protein, 354 aa, Sulfolobus acidocaldarius
MRRVLKAAILGSTGLVGIEYVRMLANHPYIKVAYLAGKGSVGKPYGEVVRWQTIGQIPKEVANMEIKPTDPKLMDDVDLVFSPLPAGAAGPVEEEFAKHGFKVISDSPDHRFEPDIPLLIPEINPHTITLIDEQRKKRDWKGFIVTTPLCAAQGVLLPLAPIYQNFKVDSVFITTMQAVSGEGYPGVASLDIIDNIKVLGENYDNKLIKEVHRVLSETKRNVNDSGNDVTLSATTHRVATIHGHYEIIYVTFKEDVNVEKVREAMDNFKGEPQNLKLPTAPSKPIILTNEDSRPQVYFDRWAGEIPGMSVVVGRLSQVNRRAIRFASLIHNTVRGAAGGGILATEFLVEKGYMD

SEQ ID NO: 204 - protein, 352 aa, Sulfolobus acidocaldarius
MRRVYKAAILGSTGLVGIEYVRMLANHPYIKPTYLAGRGSVGKPYGEVVRWQTIGQIPKEIANQEIRPTDPKQMDDVDLVFSPLPAGSAAQVEDEFAKLGFKVISNSPDHRLEPDIPLIIPEVNPHSLNLIEEQKKRRDWEGFIVTTPLCTAQGVLIPLVPIYQNFRVQSVFITTMQALSGAGYPGVASLDVIDNILPLGNEYDAKMVKEMTKVLNSTKRNVSDESNINISTTTHRVPTIHGHYAVVYVTFKENVDLGKIRESLVNFSGEPQALKLPTAPEKVIVLTEQDNRPQVYFDRWLGDPPGMSVIVGRLTQVDNNAIRFVSLIHNSVRGAAGGGILTAELLINRKYI

SEQ ID NO: 205 - protein, 350 aa, Candidatus Caldiarchaeum
MKTYSVAILGATGMVGQHYIRMLYRHPWFRITALTGKESVGRKYVEAVRGEAPEPPKEIAEMEVLPTDPKKVDADFVFSCLPTEAAREAEPKFAEAGFPVFSDAAAYRMEEDVPLIVPEINHDHLNMVHIQRKKRGWEGYIVTTPNCTTVGLVLPLQPLKQHLGVKKVIVTTMQAVSGAGYPGVASLSILGNVIPYISGEERKVETETAKILGRYGDGRFTHDSVEVHATCTRVPTLDGHMESIYLETAKPADEETVAELLAEYVSLPQELNLPTAPARPIVVRRELDRPQTRIDVDAGTVPGMSVSVGRIRVNGEKVRFISLSHNLIRGAAGGTILTAELARHMGLLGE

SEQ ID NO: 206 - protein, 348 aa, Metallosphaera yellowstonensis
MDKLRVSLLGSTGMVGQKMVRLLSSHPFIELAKVSASPNKVGKKYKEAVKWIEEGEIPEAAQDLTVVSTSPEDHRDVDVVLSALPNELAEDVELKLVREGITVVSNSSPFRMDPEIPLINPEINWEHLRLLETQRQKRGWKGLMVKNPNCTAAILSMPLKPLLKYGLNKLVITTLQAVSGAGYNGLPFMSIGNNVIPYIKGEEDKIPKESGKMLGELQGDKIAYVKLDAVVTATRVPVKVGHMGVVTALFNSPVNAEEVRKELMNFGAFPQDRNLPTAPKHPIRVLEGEDRPQPEIDVKAEGGMAVSVGRIRQEGDSIRFVVLGDNLVRGAAGITILTLEVMRELGYI

SEQ ID NO: 207 - protein, 366 aa, Treponema azotonutricium
MNKIPVGVLGATGMVGQNYIALLNDHPWFEVRFVAASPRSAGKKYKEAVDGRWQLARAYTPSVGELVVADANDVSQARAAAKAGSCAFVFSALEMGKDEIRALEDSYAAAGIPVISNASAHRWTDDVPVLISEVNPHHADIIPAQRKKRGWDKGFIAVKPNCSIQSYTTPVYALIRAGYEIKRLIVTTMQAVSGAGYPGPASIDMIDNVVPYIGGEEEKSEQEPLKILGAIEGGAFVNAAFPKISAHCNRVPVIDGHTACVSLEFGDRKPSIEEVKRIWADFKSLPQELNLPMAPKQPIIIREENNRPQPRKDRDADKAMAVSVGRIRPCNIFDLRFVGLSHNTVRGAAGGGILNAELLKSKGYIS

SEQ ID NO: 208 - protein, 248 aa, Escherichia coli; identical to SEQ ID NO: 131

SEQ ID NO: 209 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 210 - protein, 314 aa, Metallosphaera sedula; identical to SEQ ID NO: 136

SEQ ID NO: 211 - protein, 318 aa, Sulfolobus tokodaii; identical to SEQ ID NO: 144

SEQ ID NO: 212 - protein, 196 aa, Escherichia coli
MNEAVSPGALSTLFTDARTHNGWRETPVSDETLREIYALMKWGPTSANCSPARIVFTRTAEGKERLRPALSSGNLQKTLTAPVTAIVAWDSEFYERLPLLFPHGDARSWFTSSPQLAEETAFRNSSMQAAYLIVACRALGLDTGPMSGFDRQHVDDAFFTGSTLKSNLLINIGYGDSSKLYARLPRLSFEEACGLL

SEQ ID NO: 213 - protein, 272 aa, Aspergillus terreus
METAMSKRLQGKTILITGASSGIGRSTAFEFARTCPQGINLVLTARRIDRLEEIASDIRKELGLAVKVLPVQLDISNAEEVKSFVHKLPAGYKEVDVLVNNAGLVRGVAKAPDIAEEDIDIMFKTNVTGLINMTQAILPMMLRRNDGEGAGDIVNIGSIAGREPYVGGGIYCATKAAVRSFTESLRKELISKRIRVIGIDPGQVETEFSVVRFYGDKSKADAVYAGCEPLTPDDVAEAIVFATGRRENVVIADTLLFPNHQASATIMHRKGV

SEQ ID NO: 214 - protein, 253 aa, Pelobacter propionicus
MNEKTIFITGASAGFGAACARIFSAQGNRLILTARRSDPLLTLQRELSGKTEVHVIPLDVRDRVAVKDAVESLPERFRDIDVLINNAGLALGLEPAHKVDLDDWETMVDTNIKGLMYCTRQILPGMVARNRGHIVNLGSVAGSWPYPGGNVYGGTKAFVEQFSLNLRCDLLGTRVRVTCIQPGMAETEFSKVRFKGNEKMASQVYSGTEALTAEDIAETIYWVINRPEHVNINTLELMSIDQAWSPFAVHRRK

SEQ ID NO: 215 - protein, 256 aa, Starkeya novella
MYQMLDPSTLRVLVTGATSGIGAATARRFALAGAKVVGTGRRADRLIALRDELGANFHPLEVDVRDNAALTEALAKVAAPFAPFNVVFANAGLALGLEPANAASLKDWDDMVDTNIKGLLYTVRATLPAMVERREGHVLFTGSVAGDYPYPGGNTYGATKAFVKQFSLNLIADLAGTGVRATNIEPGMVETEFSLVRFHGDAAKSDNVYAGTQAMSGEDIAEQVFFAATLPRHVNINRIQAFATCQSFSPFKVSRD

SEQ ID NO: 216 - protein, 249 aa, Pseudoxanthomonas suwonensis
MSRTVFITGATSGFGLAATRRFVAAGCRVVATGRRADRLDALVQMLGADKVHPLVFDMRDSAAMDEAIASLPEPFAGIDVLVNNAGLALGTAPANHASLDDWKVMIDTNITGLVTLTHRLLPTLVERRGVIINVSSVAGVYPYPGGNVYGGTKAFVSQFSLNLRSDLHGTGVRVTTIEPGMAETEFTVVRTHGNQAASDALYKDANPMSAEDIAEQIYYVASLPPHLNINRLEIMPVTQSFAGFQVHRG

SEQ ID NO: 217 - protein, 288 aa, Simonsiella muelleri; identical to SEQ ID NO: 143

SEQ ID NO: 218 - protein, 252 aa, Helicobacter winghamensis; identical to SEQ ID NO: 134

SEQ ID NO: 219 - protein, 250 aa, Enhydrobacter aerosaccus
MNILVTGVTAGFGRAIAELLISKGHTVIGTGRRQEKLDELQSQLGDNFIPLNFDVSDLPATKTALQTLPNDVLNNLDVLVNNAGLALGLEPADKTDFADWQQMVNTNILGLIHLTHEILPSMVANNDGYIINLSSTAGNYPYFGGNVYGATKAFVTQFSLNLRADLVGKNIRVSNIEPGLCGGTEFSNIRFHGDDAKAAQVYDSVEYVTPQDIANMVAWLIEQPKHVNINRIEVMPTAQTFAGLKVVKDL

SEQ ID NO: 220 - protein, 254 aa, Streptococcus  didelphis
MSEIVLVTGASAGFGQAIVAKLVSDGYKVIGAARRLEKLKELERQFGSEHFYALQMDVSSRSTVDAALSQLSEKWQKIDILINNAGLALGLDKAYEANFDDWITMINTNIVGLTYLTHKLLPQMIERNKGTIINLGSTAGTIPYPGANIYGASKAFVKQFSLNLRADVAGKNIRVTNIEPGLCEGTEFSSVRFKGDKERVKSLYEGAHAIRPIDIANTVSWVIAQPAHLNINRIEMMPVSQSYGPQPVYRDTKF

SEQ ID NO: 221 - protein, 251 aa, Roseomonas sp.
MIVLVTGATAGFGTAIARRFAADGARIVAAARRAERLEALKAELGADKVLPLVLDVRDRAAVMKAVEGLPAEWAAVDVLVNNAGLALGLDPAQKADLDDWDTMVDTNVKGLMYLTRAVLPGMIERKCGHVINLGSTAGEWPYPGGNVYGATKAFVRQFSLNLRADLYGTPVRVTDIQPGLVGGTEFSNVRFHGDDAKAGAVYEGADALTPDDIADAVHWVATRPARVNVNMLQVMPVSQSFGPLRVHKPGS

SEQ ID NO: 222 - protein, 271 aa, Pichia stipitis; identical to SEQ ID NO: 138

SEQ ID NO: 223 - protein, 267 aa, Kazachstania africana; identical to SEQ ID NO: 135

SEQ ID NO: 224 - protein, 252 aa, Haemophilus parainfluenzae
MQRTALVTGATAGFGTAICRTLIENGYRVIGTGRRVARLEQLQQELGENFHFLAFDISDRQATEDAFHSLPASWQSIDLLVNNAGLALGLESADKANLDDWMQMIDTNIKGLVTITRLVLPQMVERNSGHIINLGSIAGTYPYPGGNIYGGTKAFIKQFSLNLRADLAGTQIRVTNVEPGLCGGTEFSNVRFKGDDARAEKLYENVEYVSPQDIANIVLWLNQQPEHVNINRIEVMPTAQTFAPLNVARIQK

SEQ ID NO: 225 - protein, 248 aa, Burkholderia caribensis
MIVFVTGASAGFGAAIARAFVKGGHRVVATARRKDRLQALADELGENLLPFELDVRDRAAVEAVPNALPADFAAVDVLVNNAGLALGLEPAQRAVLDDWTTMIDTNCMGLVQVTRAFLPGMIERSRGHVFNLGSVAAMYPYPGGNVYGATKAFVRQFSLNLRADLHGTPVRVTDIEPGLCGGTEFSNVRFRGDDEKAAGVYQNVQPLTAEDIADSIYWIATRPAHVNINTIELMPVAQSFAGLNIHRG

SEQ ID NO: 226 - protein, 382 aa, Amycolatopsis mediterranei
MTTSTEDRTAFAESIRAFARDRLAAGALERAHAPGYPWEVAELLAQQGLLGLTVPEEDGGQGATLLDAVLAIQEIGLVCPKSADVVQAGNFGALRTFAEYATDDQKARFLPGFLAGKSLLGLAMSEPEAGSAVTDLTTSAERDGDSYVVDGTKIWSTHSVEANVFLVYVRFGPGVGGIGSVLVERGTPGLEIGKPSEYMSGEQWAPLYFDGCRIPAENVLLGPGGFKKQISGFNVERLGNAARSLTLGRLAFTIARDHVLQREQFGRTLADFQGIQWKFADMAVALDGAQLLLDRAAANAAQGLPSAYETSVAKLAANQAGFQAADQALQVMGAMGYSTETLVEYCFRRTRGWMIAGGSLEVLRNRIAEDVLGRRFSQRAPK

SEQ ID NO: 227 - protein, 250 aa, Collimonas fungivorans
MTMIVLITGATAGFGAEMARKFTKNGHQVIATGRRKDRLDQLAAELGAAVLPIVMDVTDKASISSALAALPPAWQEIDVLVNNAGLALGVESAQQASLEEWETMIETNCKGLVTMTRLVLPGMVARGRGTVINLGSIAGEYPYPGGNVYGATKAFVKQFTLNLRADLVGTGVRATDIAPGLCGGTEFSNVRYRGNDEAAAKVYEGTQPLTPGDIADTAYWVATLPAHININRIEMMPTCQGFAGMSIKRN

SEQ ID NO: 228 - protein, 249 aa, Rahnella aquatilis; identical to SEQ ID NO: 139

SEQ ID NO: 229 - protein, 131 aa, Sulfolobus islandicus
MRVVVDTGVLVEVLEGSKLGEKFLKLVNSSKLEPIITNLTLIELTYIICRKYGINKARELVKKLLDSGYFEVVNALEFADDIIETKCNNSISIIDASVIATAKGLGIQALFKLEKELKDKKLENVIFIENI

SEQ ID NO: 230 - protein, 196 aa, Xanthomonas translucens
MSDALHDAALDQLFRTARTQNAFRDTPVGEDTVRALYELLKWGPTAANGSPARFVFVTSAAGKEKLKPALSEGNLAKTLAAPLTVIVAHDEDFHEKLPYLFPHADAKSWFDGPREGRSESAFRNGSLQGAYLILAARALGLDAGPMSGFDNAKVDAAFFAGTAVKSNFLVNLGYGDPAGLFPRLPRLSFDEAARIE

SEQ ID NO: 231 - protein, 196 aa, Cronobacte dublinensis
MSEALSASALATLFTDARTHSAWLDAPVSDEQLRDIYDMVRLGPTSANCSPARLLFVRTPDAKARLLPALSSGNVEKTLRAPVTAIVAWDHEFYEALPQLFPYADARAWFTSSPAVAEETAFRNSSLQAGYLIMACRALGLDTGPMSGFDRAAVDAEFFSGTTWKSNLLINIGYGDAATLHPRLPRLSFDDACAIV

SEQ ID NO: 232 - protein, 196 aa, Pantoea dispersa
MSTPLDSVALNALFTEARTHSYWQDKPISQEVLKQLYALTALGPTSANCSPGRFVFVTSQEGKEKLKPALSSGNVDKTMAAPVTVIVAWDPTFYEALPKLFPHGDARSWFTSSPDLAKETAFRNSSLQAGYLILAARSLGLDAGPMSGFDPAKVNAAFFSENNWQVNLLINLGYGEASKLHPRLPRLSFDEASKFA

SEQ ID NO: 233 - protein, 196 aa, Klebsiella oxytoca
MSEAISPAACAALFTEARTHNGWLDKPVSDAQLRELYDLLKMGPTSANCSPARFVFVRTPEGKEKLRPALSSGNIAKTLQAPVTAIVAWDRAFYDRLPELFPHGDARSWFTSSSQMAEETAFRNSSLQAAYLIFACRALGLDTGPMSGFDREKVDAAFFADGAWKSNLLINIGYGDPGKLYARLPRLSFDDACQLV

SEQ ID NO: 234 - protein, 196 aa, Enterobacter cloacae; identical to SEQ ID NO: 132

SEQ ID NO: 235 - protein, 295 aa, Pseudomonas putida
MRIAFIGLGNMGAPMARNLIKVGHQLNLFDLNKAVLAELAELGGQISPSPKDAAANSELVITMLPAAAHVRSVYLNEDGVLAGIRPGTPTVDCSTIDPQTARDVSKAAAAKGVDMGDAPVSGGTGGAAAGTLTFMVGASTELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKE

SEQ ID NO: 236 - protein, 298 aa, Pseudomonas aeruginosa; identical to SEQ ID NO: 124

SEQ ID NO: 237 - protein, 292 aa, Bacillus cereus
MEHKTLSIGFIGIGVMGKSMVYHLMQDGHKVYVYNRTKAKTDSLVQDGANWCNTPKELVKQVDIVMTMVGYPHDVEEVYFGIEGIIEHAKEGTIAIDFTTSTPTLAKRINEVAKRKNIYTLDAPVSGGDVGAKEAKLAIMVGGEKEIYDRCLPLLEKLGTNIQLQGPAGSGQHTKMCNQIAIASNMIGVCEAVAYAKKAGLNPDKVLESISTGAAGSWSLSNLAPRMLKGDFEPGFYVKHFMKDMKIALEEAERLQLPVPGLSLAKELYEELIKDGEENSGTQVLYKKYIRG

SEQ ID NO: 238 - protein, 298 aa, Alcaligenes faecalis
MSNTIAFIGLGHMGKPMALNLLKAGHRLKVFDLNAEAMKELQAAGAQVGESGAQIAKEAQMVFTMLPAGRHVRQVYEGENGLLQAVAPGTVLVDCSTIDAQTSQDLATKAAKLGLLMLDAPVSGGTGGAIAGTLTFMVGGEDQALEKARPYLDAMGKNIFHAGKAGAGQVAKICNNMLLGILMAGTAEALALGVAHGLDPAVLSSIMARSSGRNWATELYNPWPGVMPDVPASRDYQGGFATGLMLKDLGLAADAAVSQNSATPLGELARNLFALHAAQGQNAGLDFSSILNLYRQKR

SEQ ID NO: 239 - protein, 2398 aa, Lytechinus variegatus
AACTACCCAGGGGTTCAAAGCATGGTTGCAAACAACCTTTCAATGTTAATTTGGGTCTATTTGTTTAACAATGCATGTACATCAATGAGTCGTAGTGTGAATGAATTTGCAACCAAAACCCACACCTCAAGTATAAACTACATTTCTTTTTACAAAGACAAGATGAGCGTCTGTGTGTTGGAGGGGGGGGGGAGTACTTTGCAGTACATTATATGTAAATAAATAAAGTAAGATATATGATTGTAGAATACATAAAAGACCATGAGAATACAGTGAACAAATCAAACTTGAAATCAATAAAGAATTACAGGAAAAAGGATGAATAAGCACACAATGTGAAGTCCTAATAACAAGTCCTTCATCTCCATATTTTCCCACTCTGTAAAATATATACAATATTTCATGATTTCTAGACTAGATTATAATGCCATCCCACCTCTTTTTAATTATTCAGCCATTAATATCAATCAATAAAAATTGAGATTGCATAAAGTAAGCATTGTCAACAGGAGTGTTTATCATGAAAGGATACAAGTTACCTTAGTAACAGTGCTTTCAGGACGCAATCTGTCAAAGGCTTAATCTTATTTCAGAATAGGATAAAAGATACTACATCCCCAAAATATATACATTTTATATTCAATAGACATAATAGGTCCCTTGCCTTTCCATTCAGTCCCATTCCTGTCTTAAAAAGTAAACTCATTCAGATTTAAAATGAAACTTTAATTTCAAATAAAAATGCAGATAAAAAGATTGATATTCATTAAAGCAATAGTCTCACAATATTTCATGTTTCATCTTTAAATACATTTTAAAAGTCATCCAATTGACTACAAGTCCCAAATGTTGAACTGTTCCTTTTGTTCAATAAATTTTTCAATGAAATTGTCGGAAAGGAAATCAATTTCAAGACAGTATTTCAATGCTTTCGAGAAGTCACCGTGATTCAGTAAGAATGACGCATTTACTACTGTAGTGCATTTGCAAGAAGAATAATGATTGTGACAAAGATGGCTGAAAACATTGTCTAATAGTAAAAGCATTCACTTCAATAAACTATCTGCTTTTATGAGTATCAACCAGTAAGCTATGGGAGGTGTTTCATAAAGCTGTTATATAAGACTGGTCACCTGATATTGATGCTGAAATCAGATTCACTTTCATTTTTATTCCCTTGAGATACAGATGAAATCCAATCTTCACATTAAAATTCACATCTTATACAAGCATCTGAATGAACAATTCAAACATTTTCATACAGGTTATGGAAATGCACTCCCATAATGGGTGAGCATCAGCAGTCGTGTATAACAGCTTTATGAAAGCTTGATGACTATGATGAATCCTGCTGCTCCTTGAGAAACTGATAAACTGATGAGAAATCTTTGAGTGAATATCCTTGGTTGCACATAAGACGATATATTTGATTACTAAGTGAACCTAATGGAATAGGTGACTTGGTGTTGATAGCTGCTGCATTGGATAAACCAAGATCCTTTGCCATGAGAGCAGTACCAAATCCTCCTTGATAATTATTACTTGATGGCACTCCTTCTATTACCCCTGGAACAGGATTGTAGGTATCTACAGACCAGCATCGACCAGTGCTTGTACTTAAGATATCGGCTAATATCTTCTTATCTAAACCTAACCTTGTACCAAGATTCATGACTTCTGAGACACCAATCATGGAGATGGCCAGTAACATGTTATTGCATATCTTTGCTGCCTCTCCTGTACCTACTGCTCCTGTATGCCAGACCTTTTTACCCATATTGAGTAATAGCTCCTCAGCAGCAACAAACTCTTCAGTCTTACCTCCAACCATGAATGTCAAGATACCATCTCTAGCAGCATTCACACCACCTGATACAGGTGCATCCATGAATGTAGCTCCTTTCTTCTCTGCTATTGCTGCTACATCTTTAGATACCTGAGGGTCAATCGTACTGCTATCAATCAATAATGTACCTGGCTTTACTGACGATAAAATTCCATTTTCTCCAGTATAAACTTCCAAGACATTTGGACTAGAAGGCAGCATGGTGATGATACGATCAGCTTTCTGAGCTACATCAGCTGGAGTATCCCCAACCTGGGCACCAAGGTCAGCTAGATCAGCTACAGCTTCAGGATAAACATCATTGACAACGACCGGATAGCCCTTGTTGATAAGATTCTTAGCCATGTGAGCCCCCATGTTGCCTAAACCTATGAAGCCTACAGGTGCCATGGATGCCATACTCTTGGCTGATGTTTCTCTGTGGTTGCAGCATTCCAGTAATCTCGATGATACCACTGGAAAAAGTCTGGAGCTTCGAAAGACAGTAGAAGTTGCGGATAACATTTTCTTTCTCTCAATTCAACTCAACTCTCGAACCAAGGGCAAAGCCTG

SEQ ID NO: 240 - protein, 1067 aa, Chyphotes mellipes
GCAGGTAATACACGTGAAATATCGCGTACTTGCTAGTTTCAAATTCATTTACGGATACTATCGGACATTAAATAGCGTATCTTAATATGTCGTTATTGTTTACGAGGTGCAAGATACTATTCGAAGATCGGATTTGTGGGTTTGGGCAACATGGGTGGCCATATGGCGAGGAATCTCTTGAAAAAGGGTTACAAATTGACCGTGTTCGACGTCAACAAATTGGCAGTTGCAAACCTAATCGAAGCCGGCGCAACTGGTGCTTCGAGCAGCGCTGAAACGTCGAAGGATGCGGAAGTTGTTATTTCTATGTTACCCTCTAATCAACACGTTCTGGACAGTTACACCGGGGACAATGGTGTATTAAGTTCGGCGAGGAAAAACGTTCTGCTGATAGATAGTAGCACTGTAGATCCATCAGTGTCACAGGCTGTCGCGAGGCAAGCCGAAAAGTGCGGCGTCCGTTTTATAGATAGTCCCGTATCTGGAGGCGTAAACGCTGCGAGAGACGGTACTTTGACATTCATGGTAGGCGGTTCCCCAAAGAATTTTGAGGACGCCAAGCCGATTCTCGAAGCGATGGGATCGCGAATCGTGCATTGCGGCGAAGTTGGAATGGGTCAAGCAGCGAAATTGTGCAACAATATGTTATTAGCCATCAGTATGATTGGCACTGCGGAAGCCTTTAATTTAGGGCAAAAATTAGGACTGGACGCGAAAGTATTGGCCGATATCGTCAATTCGAGTTCGGGAAGATGTTGGTCCTCTGAAGTTTACAATCCCGTTCCGGGAATTCTTCCTAATGTTCCCAGTTCGAAGAATTATGAAGGAGGTTTTGGTACGACCTTAATGGCAAAAGATCTGGGTTTAGTGCAAGCTGCTGCAACCAGAATGGAAGCGCCGATTCCTTTAGGATCTCTAGCCCATCAGATATACAGAGCAGTCATTGCTAATGGGTACTCGAGCAAAGACTTCAGCGTTGTATATCAGTTTCTAAAAGGCAAAAGTTCAGAAAGTTCATAAAGATATGCGGGCATGAATCTTTTAATACTATCATGACTATAATAGAA

SEQ ID NO: 241 - protein, 347 aa, Populus trichocarpa
MAICRLRASLSLLKTKSPFFHYVPLHGFSSSQLSSQFESVGFIGLGNMGSRMANNLIKNGYKVAVHDINCNVMKMFSDMGVPTKETPFEVAEASDVVITMLPSSSHVLDVYTGPNGLLRCANLMRPQLLIDSSTIDPQTSRKVSVAVSNCILKEKKDHWEKPVMLDAPVSGGVLAAEAGTLTFMVGGSEDAYLAAKPLFLSMGKNAIYCGGAGTGSAAKICNNLALAVSMLGVSEAFVLGQSLGISAGTLTKVLNTSSARCWSSDSYNPVPGVMEGVPASRNYAGGFASKLMAKDLNLAATSAKEVGLQCPLTYQAQEIYTELCKDGHESKDFSCAFRHYYSGQDEL

SEQ ID NO: 242 - protein, 299 aa, marine gamma proteobacterium
MTNIAFIGLGNMGGPMAKNLLAAGHTLHIFDLSEVALNDVASAGATIAGSAVEACKTAEVVITMLPAGKHVRQVYIGDNGLLDHLSPGTLCLDASTIDSDTARDVGLAVAQQGIEFMDTPVSGGVAAAQAGTLAFMCGGTSDAFDRAKVILEAMGNGEKIFHAGPAGAGQVAKAANNMLLAVHMIGTCEALAMGAKAGLEPGVLSEIMKASSGNNWSLQVYNPWPDVMPGAPAGNAYQPGFMVDLMVKDLGLAKEVADGTGVDNKLGRLALEMYQAHQSGGNGSLDFSSILNSVLESSN

SEQ ID NO: 243 - protein, 292 aa, Clostridiales sp.
MKKIGFIGVGIMGKSMVRNLKKAGFDLHIYARTKAKVEDVIAEGVTFHDSIADCVKDCEAVITIVGFPQDVEEVYFDQGNILDSAKEGAYLIDMTTTSPQIAQKIYEEGNKRGFHVLDAPVTGGDTGAKAGTLSILVGGDKEDFEACMPLFEAMGTNINYQGAAGCGQHCKLANQIMIAGALSGVCEALAYAQAKGLDLQTVLHSVSTGAAGSRQLDLFGPKILEGDYRPGFFMKHFIKDMKLALIESNISGLDLNVLSQVLAEYEELQAEGLGDEGTQALFKLYTQEKADE

SEQ ID NO: 244 - protein, 297 aa, Robiginitomaculum antarcticum
MTTIAFIGLGNMGMGMAVNLAKAGHEVRAFDINDAARASAAQQGCVDAGTLKSAVADADIVVTMLPAGRHVSMVYGDEGGIFSHAKAGALFIDSSTIDVTTARKVINEATHLGYRMIDAPVSGGVAGAAAGTLTFMCGGTDEAYAAAKAYLDIMGKNVFHAGAAGNGQVAKIANNMLLGIHMIGTCEAFNLAEKLGLDAQTFYDISSTASGQNWSMTSYCPAPGPVPSAPSNKDYKPGFAAAMMLKDLRLAKDAAESANASTPMGLRAAELYELMEKGGHDGLDFSGIMKLIKGELG

SEQ ID NO: 245 - protein, 293 aa, Thiomonas sp.
MNTKAQPLRIGFIGLGIMGRSMAGHLLAAGHELRVYNRSRDKADDLVARGARWCDSPGEVAAGSEIVVTMVGYPADVENIYLGAGGIVERAAAGTLLVDMTTSSPSLARRIAQAARERGCGALDAPVSGGDVGAREARLSIMVGGEAADFERAQPVLALMGTNIVRMGGPGTGQHTKMCNQIVIASTIVGVTEGLVYAQRSGLDPSTVLQAIGGGAASGFQLNVLGARIVAGDFAPGFFIEHFLKDLGIALGEAEQMGLDLPGLALARGLYQRMAERGLGRDGTQALIKLYQG

SEQ ID NO: 246 - protein, 288 aa, Lactobacillus shenzhenensis
MKIGFIGTGVMGTGMIKNLLQHGSDVTVFNRTKAHAQPVLEAGAKWADSPAALARQSDVLISIVGFPKDVEQVYFADNGVFAGAHAGLTVIDMTTGSPETAKKITAVAKQYPGMAALDAPVSGGDIGAQKGTLTIMVGGEQPVYDRMLPIFQQMGQTITYCGPAGSGQHMKMANQIMIAGTMTGMTEMLVYAKAAGLDLTQALHTLAGGAAQNWSLDNYGPRILKEDYTPGFFAKHFLKDLRIALDEADRMGLELPATAEAKHLYEVMVDGDGLGDLGTQGLIKLWWR

SEQ ID NO: 247 - protein, 296 aa, Azospirillum brasilense
MATIAFIGLGNMGAPMMRNLLKAGHTVLAFDLSEAACTAARDAGATVATGPGAAAGEAEVVVTMLPAGKHVREVYTAPDGIIAKAKPGSLFIDSSTVDVDSARFVAAAAEAAGHAMVDAPVSGGVGGAEAATLTFMVGGSDTAFRRAEPILSAMGKAIVHTGGPGNGQAAKICNNMILGISMLGVSEAFALAEKLGLESQKLFDVASKSSGQCWSLTSYCPVPGPVPTSPANRDYQPGFAAALMLKDLKLAVEAGQSTGSPLPLGGEAAQMYALFCNAGFGGKDFSGIVNLLRGKP

SEQ ID NO: 248 - protein, 288 aa, Anoxybacillus gonensis; identical to SEQ ID NO: 121

SEQ ID NO: 249 - protein, 297 aa, Brevibacillus panacihumi
MEAHTEKSVIGFVGTGVMGKSMASHFIKAGYPVLVYTRSKEKAEEILAQGAVWKERVADLAGEANVIITMVGYPHDVEEVYLGEQGVIAHAKPGTYLIDMTTSKPSLAQRIYEEAKKHALHSLDAPVSGGDIGARDAKLTIMVGGDQEAFDAMAPLLGIMGTNVILQGGPGAGQHTKMCNQITIASNMIGVCEAISYAKKAGLDPTRVLDSIGAGAAGSWSLNNLAPRMIAGNYAPGFYIKHMIKDMSIALESAKEMGLLTPGLELAKSLYDEMAAEGEENSGTQALIKWYERNQRP

SEQ ID NO: 250 - protein, 295 aa, Xanthomonas campestris; identical to SEQ ID NO: 125

SEQ ID NO: 251 - protein, 296 aa, Burkholderia cenocepacia; identical to SEQ ID NO: 122

SEQ ID NO: 252 - protein, 303 aa, Haliangium ochraceum
MKQSSPGQTRVGWIGTGVMGASMCGHVLAAGYEVTVYNRTKARAEALLAQGAQWAETPRAVAEAADVVFTIVGYPGDLREVMLGDDGILAGVSEGAVVVDMTTSEPSLAESLAEQAAERGARCVDAPVSGGDVGAREARLSIMVGGEADAVAAVMPLLETMGKTIVHQGGPGAGQHTKMVNQILIATNMIGVCEALLYGYRAGLELETVMRSVASGAAGSWSLSNYGPRIINNRFEPGFFVEHFIKDMGVALSEAQRMGLSLPGLALAQQLYVALAAQGHGRDGTHSLQLALAQLSGIDWRER

SEQ ID NO: 253 - protein, 295 aa, Marinobacter adhaerens; identical to SEQ ID NO: 123

SEQ ID NO: 254 - protein, 300 aa, Shewanella oneidensis
MSTVAFIGLGNMGGPMAANLLKAGMTVRVFDLVHTAMQTLAEQGALVSSTACGAAAGANVVITMLPAGKHVKNLYLGSGSEKGLLDVVASDTLLIDCSTIDAQSAQLVATQAAKNGLEFMDAPVSGGTSGAAAGTLTFICGGSDTAFERAQPVLNAMGKNIFHAGGPGAGQIAKICNNMLLSVLMVGTSEALQMGIDHGLDPKVLSNIMKVSSGGNWTLEKYNPCPGVMENVPSSKGYQGGFMVDLMVKDLGLSFEAALLSNSSTPMGALARSLYVSHARQGNGHRDFSSIFEQFAPLKK

SEQ ID NO: 255 - protein, 382 aa, Cupriavidus necator
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 256 - protein, 371 aa, Clostridium kluyveri
MKLLKLAPDVYKFDTAEEFMKYFKVGKGDFILTNEFLYKPFLEKFNDGADAVFQEKYGLGEPSDEMINNIIKDIGDKQYNRIIAVGGGSVIDIAKILSLKYTDDSLDLFEGKVPLVKNKELIIVPTTCGTGSEVTNVSVAELKRRHTKKGIASDELYATYAVLVPEFIKGLPYKFFVTSSVDALIHATEAYVSPNANPYTDMFSVKAMELILNGYMQMVEKGNDYRVEIIEDFVIGSNYAGIAFGNAGVGAVHALSYPIGGNYHVPHGEANYLFFTEIFKTYYEKNPNGKIKDVNKLLAGILKCDESEAYDSLSQLLDKLLSRKPLREYGMKEEEIETFADSVIEGQQRLLVNNYEPFSREDIVNTYKKLY

SEQ ID NO: 257 - protein, 377 aa, marine metagenome sp.
MTQLAYSNRPYFDHGAIKEISVVLENLGIKKPLICTDPGLAEIGMIDQLRNQLSNEITPSFYDQTPANPTEEAVENALEIYKTQGCDGVIGFGGGSSLDLGKSVALMVNHEGKVVDYSINEGGLEKIQKTIPMIAIPTTSGTGSEVSSGAVIIMNDGRKLILASEHLRPAAAICDPELTIGLPPILTAGSGMDALTHCIEAIMSPVIDPPAEAVGLDGVERVIKGENLKRAVKDGNDKDARWNMMMASTEGAMAFSKGLGAVHSMSHALGADQELRLHHGTLNGVILPTILRFNKDHVGDKYSKIARAMGKPESTDLAIEIEKLNEEIGLPSGLKDMGVTEVMIPDLVEHSMTDPSNATTPRLPSKEEWEKLFLDAM

SEQ ID NO: 258 - protein, 370 aa, Anaeroglobus geminatus
MQELALKATILHYHTCRQMVIDLNITADDLILTNQYIYGPYFAEFNLPCQVIFQEEYGAGEPSDDMTEAIYKDIQGNPKQIIAIGGGTIIDLAKFFCLKNVIPVLDLYDGIMEPVKERELVIVPTTCGTGSEVTNVAVLSLNGRNMKKGLAVEAFYADKAILVPELLQTLPSKVFATSSIDALVHAVESALSPKASETTKIFSYKAIEKIIGGYIQIRERGIDARFPLQEDFLMASTYAGIAFGNAGCAAVHAMSYPLGAMYHVAHGESNYAMFTGVMKAYMQRRQDGEISRLNAFIANLLDTTTDRVYEELETLLNVILPKKPLHEYGVKESDLKSFANSVATNQKRLTDNNFVPLKEGDYLEIYQSLY

SEQ ID NO: 259 - protein, 371 aa, Dorea sp.
MKLFMQKPLIQKFDHAKEFVEAYQIGEGDFILASKRIYETYFAPLNLKARVEYKSNYGAGEPTDVMINALLADFRKAGCDRIIAIGGGAVIDMAKILVLDGNAAAEQYFRREVPLRKVHPLIAVPTTCGAGSEVSNVSITELTSIHSKLGLAVDEIYADDAVLIPELLTELPYEFFATSAIDAFIHAIESYVSPKANLYTKMFSMKAMEMIIEGFRAIAEKGPEYRMELLEQFLIASNLAGIAFGNAGTGMVHAMSYPLSGHYHVAHGEANYQFLTAVFAAYQKMKPEGEIRELNQFLGNLLKCEEDIVYIELEKLLDRMIGRKKLREYGMKEEEIRLFAESVNESQQRLLNQSYVKPTVEQMEEVYRQLY

SEQ ID NO: 260 - protein, 371 aa, Fusobacterium sp.
MKQLILKPELHKFQTCKEFAKEFELGEDDLILTNEYIFNPYFKELNLPVKTIFQEKFGAGEPTDIMVDAIINEAAKHTFKRIIAIGGGTIIDIAKVLAVTNGESVDKLYDKKNELKKHYELIIIPTTCGTGSEVTNISIINRTRLGVKMGLTSPEMFAEMAVLIPELLRSLPFKVFATSSIDALVHSVESSLSPKATDYSKLFGYKAIEMIITSYQRLVKEGKEILPDLMDTFLTASNFAGIAFETAGCAAVHALSYPLGAKYHVPHGESNYAVFTGVLKNYMEIKQDGEIATMNEFLANLLHCDVKVVYEELENLLNSVLQKKPLHEYGVTEKDAEDFAESVIKTQGRLMANNFVVLDYDRVLKIYKELL

SEQ ID NO: 261 - protein, 370 aa, Odoribacter splanchnicus; identical to SEQ ID NO: 119

SEQ ID NO: 262 - protein, 378 aa, Polaromonas sp.; identical to SEQ ID NO: 120

SEQ ID NO: 263 - protein, 377 aa, Chromohalobacter salexigens
MSSIINYLTKIRFGADALDDLAEELSLLGVARPLIVTDAGLTASGLVDRVQAAIGGKQPAPVYDETPANPTEVAIEAAVACYHEHGCDGIVALGGGSSIDLAKGVALLASHQAPLRQYAVIEGGAARIGSEVLPLVAIPTTAGTGSEVGRAALISMRDERKLGFLSPHLIPDVAICDPVLTLSLPATLTAATGMDAIAHCVETFLSPRFNPPADAIALDGLQRATRHIRTAVHDGNDLEARSEMLMAATQGALAFQKGLGAVHSLSHALGGFHDLKLHHGTLNALLMPCVLRFNQPHCEDKFDRLRQAMGLAPGTDLAEAFIQLNRDLSLPMRLSELGVTRDRLAPVAQWALEDHSTATNPRPPTLEDFQRLLEEAF

SEQ ID NO: 264 - protein, 379 aa, Burkholderia sp.
MALINYITQIQFDFGAVRLLASECERIGIRRPLIVTDAGIRAAGLVDTVLDALGSSAPVPVFDATPPNPNEAAVRAAVAMFKENACDGVIAVGGGSSIDLAKGVAVCATHDGPLQSFAVIEGGLARITAKTAPVIAIPTTAGTGSEVGRGAILILDDGRKVGVISPHVVPKVAICDPELTLGLPPMLTAATGMDAIAHCLETFMAPAFNPPADGIALDGLWRAWRHIEGATRDGSDRVARLNMMSASMQGALAFQKGLGCVHSLSHSLGGINPKLHHGTLNAIFLPAVIAFNASAPSMQQEDKLGRLAQAMGLESGDDVGLAVRAMTATLGLPRGLAELGVTRELFPRIVAGALKDHSHKTNPREASSADYEAMLEASM

SEQ ID NO: 265 - protein, 256 aa, Pseudomonas aeruginosa
MTLKGKTALVTGSTSGIGLGIALSLAEAGADLLLNGFGEVDAALAQVRARGVRAEHHPADLSSPEQIGELMAFAERTFGGVDILVNNAGIQYVAPVQEFPTERWDAIIAINLSSVFHTTRLALPGMLARGWGRIVNIASTHGLVASAGKSAYVAAKHGVLGLTKSVALETARTPVTCNAICPGWVLTPLVQKQIDARTAEGVSPEQAEHDLLAEKQPSLAFVTPEQLGGLTLFLCSEAADQVRGAAWNMDGGWVAQ

SEQ ID NO: 266 - protein, 282 aa, Brevundimonas subvibrioides
MFQWPGKKDDEATERPVYRDPNDLKGQVAVISGSTSGIGLALARAVASRGGDVVLNGLGDPSEIERTRAELEASCGVRVRYHAADMLKGDEVADMVAFAKHQLGRVDILVNNAGIQHVEAVEKFPSDKWEQIIAINLSSTFYATRAAIPIMKAQGRGRIVNIASAHGLVASPFKSAYVAAKHGVVGFTKTVALEVARDNITCNAICPGYVETPLVQSQIADQARARGISKEKVITDVILEAQPTKQFVTTDQLSGLFLYLISDLGASANGAAFSIDGGWTAQ

SEQ ID NO: 267 - protein, 262 aa, Rhodopseudomonas palustris
MTNLTGKTAVVTGSTSGIGLSYARAFAKAGANVVINGMGEADAIEKERKAIESEFAVKAVYSPADMLKPAEIAEMIKLGETTFGSVDILVNNAGIQFVSPVEDFPIEKWDAIIGINLSSAFHGIRAAVPGMKKRGWGRIINTASAHSLVASPFKSAYVAAKHGIAGLTKTVALELATHKITCNCISPGYVWTPLVEKQIPDTMKARGLTKEQVINDVLLAAQPTKQFVTPEQVAALAVYLCGDDASQITGANLSMDGGWTAA

SEQ ID NO: 268 - protein, 273 aa, Bradyrhizobium sp.
MAADTMKTGPSLRSLAGRVAVVTGSTSGIGLGIARALAEAGVHVVLNGFGKPEEIDRIRSQIASEFGVRTGYAAADMMQPAAIERMIEGVMEEFGRLDIMVNNAGIQHVAPLEEFPVEKWDAIVAINLSSAFHTMRLALPAMRRHGFGRIINIASAHGLVASPFKSAYVAAKHGIIGLTKVAALEAAESGITCNAICPGYVYTPLVEAQIDGQAKAHGISRDQVIRDVLLAQQPNKRFATVEEIGALTVFLASEAAASITGVALPVDGGWTAH

SEQ ID NO: 269 - protein, 257 aa, Thalassobium sp.
MTLAGKTAVITGSNSGIGLGVARELAKAGANVVLNSFTDRDEDYELARDIADVTGVTATYVQADMSKAEDCRRLIDAAGGCDILINNAGIQYVAPVEEFPVAKWDAIIAINLSSAFHTTAAAIPGMKDRGWGRVINIASAHGLTASPYKSAYVAAKHGIVGLTKTVALETAQLPITANAICPGYVLTPLVESQIPDTMKEYDMSREDVIKTVMLERQPSKEFATTQQLGGTAAFLCSDAAAQITGTTISVDGGWTAL

SEQ ID NO: 270 - protein, 258 aa, gamma proteobacterium
MTQLALVTGSTSGIGLGIAIALAEAGYRLVLNGFGESEVIDQAVADVAAVSASSPIYVGTDLTQPQAIETALAEVIASEGPISVLVNNAGMQFTAPVDAFPTEKWDQIIALNLSAAFHTTRLCLPGMKAQNFGRIINIASVHGLVASINKPAYVAAKHGLIGLTKATALETAEIDITCNAICPGWTHTPLIQEQIEKRAMELNITSEAGGRALLTEKQPSKQFVTTDQLGALTRFLCTDAASQITGASLPVDGGWTAQ

SEQ ID NO: 271 - protein, 265 aa, Kaistia granuli
MSKDGHLKDRVALVTGSTSGIGLGIARSLAGAGAHVVLNGFGDPAVIEKLRAGLAAEFGVEVRYFGADMTKEDEIAGMIRDVEREFGAIDVLVNNAGVQHVAPVDEFPVDKWNLILALNLSAAFHAIRLALPAMKQKGWGRIISTASAHALVASPFKVAYVAAKHGIAGITKTVALEVADKGITVNAICPGYVWTPLVEKQIPDTARARGMTEEQVKKDVILAAQPTKEFVTVEEVAALALFLTTDGARSITGSLQSIDGGWTAA

SEQ ID NO: 272 - protein, 258 aa, Ralstonia eutropha
MLNGKTALVTGSTSGIGLGIAKALAAQGANIIVNGFGDADAAKAEIAQAGQGIRVGYHGADMSKAAEIEDMMRYAQSDFGGADILVNNAGIQHVAAIEDFPPERWDAIIAINLTSAFHTTRLALPGMKQKDWGRIINVASTHGLVASAQKSAYVAAKHGIVGFTKVTALETAQTGVTANAICPGWVLTPLVQKQVEARAQKEGIPVEQAKRELVLEKQPSGQFVTPDELGALAVFLSSEAARQVRGAIWNMDGGWVAQ

SEQ ID NO: 273 - protein, 256 aa, Klebsiella pneumoniae; identical to SEQ ID NO: 118

SEQ ID NO: 274 - protein, 261 aa, Azospirillum brasilense
MTLTQKVAVVTGSTSGIGLGIARALAGAGADVVLNGFGEAAAIEELRAGLAAEFGVRVGYHGADLSKPAEIAALIGHAEETFGSVDVLVNNAGIQHVAPVEDFPAERWDAVIALNLSAVFHGTHHALPGMKRRGWGRILNIASVHGHVASVNKSAYVAAKHGVVGLTKTVALETAGTGVTCNAICPGWVLTPLVQKQIDAIASTKNIPEPQAKAELLGAKQPSGAFVTPDELGGLAVFLCSDSAAQMTGASLLMDGGWTAQ

SEQ ID NO: 275 - protein, 258 aa, Cupriavidus metallidurans; identical to SEQ ID NO: 117

The invention claimed is:

1. A recombinant yeast selected from *Saccharomyces cerevisiae, Kazachstania exigua, Kazachstania bulderi,* and *Candida humilis* and comprising an active 3-hydroxypropionic acid (3-HP) biosynthetic pathway of [Pyruvate→Acetaldehyde→Acetyl-CoA→Malonyl-CoA→Malonate semialdehyde→3-HP], wherein the yeast comprises:

an exogenous gene encoding acetylating acetaldehyde dehydrogenase (AADH), which converts acetaldehyde directly to acetyl-CoA and that has an amino acid sequence of at least 95% sequence identity to SEQ ID NO: 164;

an endogenous or exogenous gene encoding an acetyl-CoA carboxylase (ACC) that has an amino acid sequence of at least 95% sequence identity to SEQ ID NO: 101;

an exogenous gene encoding a malonyl-CoA reductase (MCR) that has an amino acid sequence of at least 95% sequence identity to SEQ ID NO: 203; and an exogenous gene encoding an hydroxypropionate dehydrogenase (HPDH) that has an amino acid sequence of at least 95% sequence identity to SEQ ID NO: 236.

2. A method of preparing 3-hydroxypropionic acid (3-HP) comprising:
   (a) culturing the recombinant yeast of claim 1 in a medium including at least one carbon source, thereby producing 3-HP; and
   (b) isolating 3-HP from the culture.

3. The method of preparing 3-HP of claim 2, wherein the carbon source is one or more selected from the group consisting of glucose, xylose, arabinose, sucrose, fructose, galactose, cellulose, glucose oligomers and glycerol.

4. The method of preparing 3-HP of claim 2, wherein culturing is performed at a pH in the range of 2.6 to 4.0.

* * * * *